United States Patent 11,446,398 (REGULATED BIOCIRCUIT SYSTEMS) - sequence listing, part 90

SEQ ID NO: 197870 - DNA, 10568 bp, Homo sapiens
  Payload ID: 19020
  Gene Name: UBX domain protein 7
  Uniprot ID: O94888
  ENST ID: ENST00000296328
  CDS Start-End: 76-1545
acaccgcacggcgaagtgggggagggcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcagggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaagaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtagagacagggtttcaccatgttggccaggatggtctcgatctcttgatctcgtgttccgcccacctcggcctcctaaagtgctgggattacaggcatgagccactgcgcccgatctacaattctgttttctgtgtcccatccataccagattattgaaccctctgtgtgtatgtttttaaatcttgtatataattctacttccttgacttacaagtcaacaattagctattgagttctttatagaagttggaagtattttgaaatctgagatctaattcctggccaggtgtggtggctcatgcctgtaatcccaatattttgggaggccgaggtgggtggatcacctgaggttgggagttcgagatcagcctggccaacatggtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagtaataataatcttgtaaacaattcattattttttaaaacttaatgctgtgtgcctaatcagtgttgagtatgactaaaatgtaaatgagaaccaaatatgacactaacgctggcactaaattttatttttacttgtgtacttaaagtactttactggcctgttgggaaattgatttgtataagattcacacctggttttggcagaaacagctttttaaagatacaattaggctgacttaaaaatgttttttattccacagaatgtatctttattatgtcattcttaccgtctctctgccttttttgaccatcatgtaactacgcagtagtaaatcatggggtgcaggctgatgaattagtagtctttgtaaaactaaaatgtaatgagcataggaagagacagctcttctggtgaacatggcagttttccggtaataccagccttgatgaataggctaaagacagctgtgtactatggacattcaacttcactggattgcctggcttagcttttcagttattgtcttgccgtgaaacatggtgttgcactgtacacattttagaatagtggcaagaatgttctttagaactgcagataacccaacagagaataccataccaatatatcggtttctcctgttacatagagatttggtatttcagtgatggttatggtttttgactcacctgtgtgtcagtcctgctagagagacagtatagaatcaagaatttcttgatgtctttttaaaaatagagattataatggccttgctagttgtcctgtgaagtgacagacccttaattagaaatcttttaatcctgctttccattttacttctccaccatttatttttaacattcattctctgaaaatagttatgatttttagtgtaattggctatgtttaagaaattccatttcaaagtcttaatatgtaacaatcttcattttttataaaattgaaggacatttttgaggcaaacttacttttatagctcattttctccctagttaaggagaattctctggtttcatatagagaatggctagctctgtgataccccaccctctttgtggcctaccagttgctgttgtgttgcttaaaattgcagatattctcataaacatgatgatttttggcacaggcctttctttgctattgatttcaaaataaagttgggcaatccaatttgaactactttaataaacataatttagcattcctgtaatgagaaagtattttcaaaagataaccagatttatttctaggattagagatggcaaataccaatgatagtatttttcccaagagcaatcacagattaatctataaatatgagaagtcgcattattgtacttaattctttggcaacaaacagcaagtttttattgtttaattgtatttcctctctagagatcacaatactctgggtattttatatcccttctaaaggtcatttgggttttcaaatgggaagaatagtcaagctaagctggactaaacctaagtaatattttttctcatcaaaagaagttattaatctaactgggttagcatgagtcattcattttttagacatgataaatgggaaacatatcaaatcattagataaattctgacctggaattgaattccccctttcttaaaatctttttaatttgcttttttcatagactcagtatggaactcttaactgataagggagagattcttgatctggaaccgttccctgccattctccttttttctctctatctaggtagctggttccatagtgcccgtcacgagggtccatttcagtttgatgacattagactgcttacactcagctggatgccttgctgtttgcagcaacatgattttacagtatgcttttctcaaagctttgcattcttaatggagatatcaaatggtgtaattccaaatataaatatgtttatgacactaatcatatgcttttaacaataactttttgataacttattgccctgtaagttaaaccttacacggagtgactgttgccatcagaaaatcccctttcacctgctagagagagtgaaagtagtgcgtggcctccacttttcagttaacgagtagcaagcttctagtaggggctgcttatctgacccatgtggggtcttgggccttgttactttcctgggttcgtcccttcagctggaaaggctgttgaaaacacttgccaggaaacagtaaagctgtgagagaatcttctagtcttagatatagagaaatgagtaccagttgatgctaacacgatacttagactttgaggggcttccatccaagctttggcatgaatctgttagacacggttttcttcactcctctgataatctttttttccagaatggttttttgttgttgttgttgttaacaaattctaaacatccagtgttactttttgttttgtttgttttgttttgttttgttttgttttgtttgcccttcaggaaagtcctttttcgagtaggtattgattgttccctggaaactctcagcagtgtctgtgcaggctctgtgcatgctttgtatgagttcggcttgaacaatgcatttgaagtcacctgggatgtccagttctggcatgtcttcattgattgtgtttttaaacatgtttcatgtttcatgtcattttccaaacctcactttacatcttactcagagaagttaatcaaggaatgaaatttctagggggatagggatgatgagggtgggttgggggcttgagtgaagtcaacttggggtatttgctttaaagtgttttctaaagcagttcctaacagtatttagagattccctgggatgtttgtggctcaacttattctggacaaagtgtgtgtgggggtggtcttactgagatttgcattcttaatgcaggacaggctctaaatttcatctgtactctaaatttgtgattgaatccaagaagataacagagacagtgctcctgttgtaatgtttctggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaaatcttagataactgggtgtgatctacctatagatctacctagtctataggtaataatttccagaaggaggatcttgctgtcagttggggatcctctggtttggtctgtaccaaattgtgaatactcttgctgtgttgtacccagttgctttatattaatactgcaacttgaaacggggagggtggggggacaatggggtgggggagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagta

SEQ ID NO: 197871 - DNA, 375 bp, Homo sapiens
  Payload ID: 19020
  Gene Name: UBX domain protein 7
  ENST ID: ENST00000381887
  CDS Start-End: 1-375
ggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgttcggcaagaacaagaattaagaaatggaggagctatcgataagaaattaactacccttgcagatctattccggccacccattgattt

SEQ ID NO: 197872 - DNA, 3158 bp, Homo sapiens
  Payload ID: 19020
  Gene Name: UBX domain protein 7
  ENST ID: ENST00000429160
  CDS Start-End: 29-256
gttgttcggcggcggcggcggcggtaagatggctgcccacgggggctccgcggcgtcctcggcgctgaaggggttaattcaacagttcaccaccattaccgagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagt

SEQ ID NO: 197873 - DNA, 1173 bp, Homo sapiens
  Payload ID: 19020
  Gene Name: UBX domain protein 7
  ENST ID: ENST00000428095
  CDS Start-End: 123-1106
gttgttgttcggcggcggcggcggcggtaagatggctgcccacgggggctccgcggcgtcctcggcgctgaaggggttaattcaacagttcaccaccattaccggccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaag

SEQ ID NO: 197874 - DNA, 374 bp, Homo sapiens
  Payload ID: 19020
  Gene Name: UBX domain protein 7
  ENST ID: ENST00000413584
  CDS Start-End: 146-374
actcctggcctcaggtgatccgccccccgctcagcctcccacagtgctgggattacaggcgtgagccaccgcacccggtagtgaggaggcagaggaaatgttcagaacgtaacagaaaggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatg

SEQ ID NO: 197875 - DNA, 1058 bp, Homo sapiens
  Payload ID: 19021
  Gene Name: UBX domain protein 8
  ENST ID: ENST00000620074
  CDS Start-End: 50-982
gaccttttgctgggacaccccacggcagtcgggtgcgccaagagaacagatgctctactccggcacctggaggactgtgggtataaggtgtccaagaaaaaaagctcagatctgccaacagcaggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttactttaactatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttc

SEQ ID NO: 197876 - DNA, 1202 bp, Homo sapiens
  Payload ID: 19021
  Gene Name: UBX domain protein 8
  ENST ID: ENST00000341403
  CDS Start-End: 2-691
catggcttcacgtggggttgttggcattttcttcctctctgctgtcccccttgtgtgtctggagctccggcgtgggatcccggatataggaatcaaggattttcttttgctttgtggccggattttgctactgcttgctcttcttactttaactatttctgtgactacctcatggcttaactcatttaaatctccccaagtttatctgaaggaagaagaagaaaagaatgagaaaagacaaaaacttgtgagaaaaaaacaacaagaagcacaaggagagaagggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacactataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgattt

SEQ ID NO: 197877 - DNA, 1450 bp, Homo sapiens
  Payload ID: 19021
  Gene Name: UBX domain protein 8
  ENST ID: ENST00000265616
  CDS Start-End: 26-838
gcctgcaccaggcgcttccgccaccatggcttcacgtggggttgttggcattttcttcctctctgctgtcccccttgtgtgtctggagctccggcgtgggatcccggatataggaatcaaggattttcttttgctttgtggccggattttgctactgcttgctcttcttactttaactatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacactataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaa

SEQ ID NO: 197878 - DNA, 493 bp, Homo sapiens
  Payload ID: 19021
  Gene Name: UBX domain protein 8
  ENST ID: ENST00000518059
  CDS Start-End: 1-283
aatcaaggattttcttttgctttgtggccggattttgctactgcttgctcttcttactttaactatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaag

SEQ ID NO: 197879 - DNA, 702 bp, Homo sapiens
  Payload ID: 19021
  Gene Name: UBX domain protein 8
  Uniprot ID: O00124
  ENST ID: ENST00000615729
  CDS Start-End: 1-702
atggcttcacgtggggttgttggcattttcttcctctctgctgtcccccttgtgtgtctggagctccggcgtgggatcccggatatagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactag

SEQ ID NO: 197880 - DNA, 1624 bp, Homo sapiens
  Payload ID: 19021
  Gene Name: UBX domain protein 8
  ENST ID: ENST00000380154
  CDS Start-End: 17-145
aggcgcttccgccaccatggcttcacgtggggttgttggcattttcttcctctctgctgtcccccttgtgtgtctggagctccggcgtgggatcccggatataggtaagtgtgactttttcccttcgacagtcacagctgggtaattttcacaggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttactttaactatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacactataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaa

SEQ ID NO: 197881 - DNA, 813 bp, Homo sapiens
  Payload ID: 19021
  Gene Name: UBX domain protein 8
  ENST ID: ENST00000522968
  CDS Start-End: 69-813
gttaaaggaaagacttatgtcagccccagccctggggctacccgatctgacaaagccttttacattgtatgtgtcagagagagaaaagatggcagttgggagttttaacccaaactgtggggccctggccgaggccggtggcctacctctctaaacaactagacggggtttttaaaggatggcccccatgtttgagggccttggcagcaactgccctgctagtacaagaagcagataagctgactcttgggcaaaaccggaacataaaggccccccatgctgtggtgactttaatgaatactaaaggacatcattggctaatgagtgctagactcactaagtaccaaagtttgctttgtgaaaatccccgtataaccattgaagtttgtaacaccctgaaccccgctaccttgttcccagtatcagagagccctgttgagcatgactgtgtagaagtgttggactcagtttactctagcagacctgacctccgggaccagccttgggcatcagtagactgggaactatacgtggatgggagcagctttatcaacccacaaggagagagatttgcagggtatgcggtggtaactctggacactgttgttgaagccagatcgttgccccagggcacttcagctcagaaagctgaactcattgctttaattcgggccttagaactcagtgaaggaatcaaggattttcttttgctttgtggccggattttgctactgcttgctcttcttactttaactatttctgtgactacctcatggcttaactcatttaaatctccccaagtttatctgaagg

SEQ ID NO: 197882 - DNA, 2382 bp, Homo sapiens
  Payload ID: 19022
  Gene Name: UDP glucuronosyltransferase 1 family, polypeptide A1
  Uniprot ID: P22309
  ENST ID: ENST00000305208
  CDS Start-End: 41-1642
aagtaggagagggcgaacctctggcaggagcaaaggcgccatggctgtggagtcccagggcggacgcccacttgtcctgggcctgctgctgtgtgtgctgggcccagtggtgtcccatgctgggaagatactgttgatcccagtggatggcagccactggctgagcatgcttggggccatccagcagctgcagcagaggggacatgaaatagttgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 197883 - DNA, 3389 bp, Homo sapiens
  Payload ID: 19022
  Gene Name: UDP glucuronosyltransferase 1 family, polypeptide A1
  Uniprot ID: P22309
  ENST ID: ENST00000360418
  CDS Start-End: 1-1335
atggctgtggagtcccagggcggacgcccacttgtcctgggcctgctgctgtgtgtgctgggcccagtggtgtcccatgctgggaagatactgttgatcccagtggatggcagccactggctgagcatgcttggggccatccagcagctgcagcagaggggacatgaaatagttgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagaaagaagcagcagtcaggaagacagatgtgaagagctggagcatgttcagatgagaggagacggaacacggggacacaccagcttgagcaagggacaacaggggaggactgatgactgacttcccacctttgaggtgctaatgtgtgtgtggtggcactggataaaagatcaatgttggctaggcaccatggcacacgcctgtagtcccagccactctggaggctaaggcgggaggattgcttgagcccagaagttggaggctgctatgagccgtgatcatgccactgcactccagcaacctgggcaacagagtgagaccctgtctcaaaaaaaaaaaaaaaaatgaaaagtccacataacctgagcatcatgtgcccagagcgttgggtggtgtggtcccattccttccttccagcggcttcttctggccacctcaatgtcaggatgtcctgctcacatatcaataccattaaaacctgacttctttccctgcactgttgaagctccttcttgaggctcacattatggatataattttgattctttcttcagtggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgattccaacactctgagctggggatagtgcctacacaaaataaaaagaagtggaaaattttcaaacatcagtttatgctgacaaccaggccataataggtgctcaattactattgaatgaatgaatgaaagttctggccaggtacggtggctcatgcctgtagtcccaacactttgggaggccgaggcaggtggatcacttgaggttaggagttcgaaaccaacctgaccaacatgaagaaaccttatctctaccaaaaaaatataaaaaaattacccaggcatggtggtgtatgcctgtaatcccagctatttgggaggctgaggcaggaaaatcacttgaacctgagaggcggaggttgcagtgagctgagattgtgccactccactccagcctgggcgacagagtgagactccgtcttacttaaaaaaaaaaaaaagaaggttccaagaaaattcatcttaaggtttatgtaaaaggaagatgatatttaacatgattcatggccaagtactaatattacattataataatgtttccaaataacattatagatatgtttaaagacagtgtattaggctgttcttgcattgctgtaaagaaatacccaagactgggtaatttataaagaaaagaggtttcattggctcgtgtttctgcaggctgtacaggaagcttagtgctgacatcacttggctgccgggggaacctcagggagcttttactcatggcagaaggcaatgcgggagcttgcatgtcacatggcaaaagcaggagcgagagagagttgggggggaaggtgccacacactttttaatgaccggctctcacaataactcatgaaaactcactatcaggaagacagcactaaagcacaagggatccgaccccatgatccaaacacctcccaccaggccccatctccagcactggggattacaattcaacatgagatctgagtgtggacaaatatccaaactgtatcagtcaacagcgatcataattagtcctgaataggagtgcctttttttttctttcttctcccttttcttttctacttcctcctccttttccctctcctcttcaatctcctcttcattcctgtagcaccaagggttgaagcacctaacccgttttggattgagatgttctgattgggcaatgaacactgtccagaataaacagaaatccattttgcactaagtggctgcacagaccctgcctcatgctaaatctagcacccagatagtttaatgtttcaatgactgaattacaaatatatcatcaccttggatttggcacttacaaatggctgttaatttggccagaggtggttgtttacaacttcaaataggagactattcataatttctgacgtg

SEQ ID NO: 197884 - DNA, 2408 bp, Homo sapiens
  Payload ID: 19023
  Gene Name: UDP glucuronosyltransferase 1 family, polypeptide A10
  Uniprot ID: Q9HAW8
  ENST ID: ENST00000344644
  CDS Start-End: 70-1662
gtacttcttccgcctactgtatcatagcagcttagaatcccagctgctggctcgggctgcagttctctcatggctcgcgcagggtggaccagccccgttcctttatgtgtgtgtctactgctgacctgtggctttgccgaggcagggaagctgctggtagtgcccatggatgggagtcactggttcaccatgcagtcggtggtggagaaacttatcctcagggggcatgaggtggttgtagtcatgccagaggtgagttggcaactggaaagatcactgaattgcacagtgaagacttactcaacctcgtacactctggaagatcagaaccgggaattcatggttttcgcccatgctcaatggaaagcacaggcacaaagtatattttctctattaatgagttcatccagtggttttcttgacttatttttttcgcattgcaggagtttgtttaatgaccgaaaattagtagaatacttaaaggagagttcttttgatgcagtgtttctggatccttttgatacctgtggcttaattgttgctaaatatttctccctcccctctgtggtcttcaccaggggaatattttgccaccatcttgaagaaggtgcacagtgccctgctcctctttcctatgtccccaatgatctcttagggttctcagatgccatgactttcaaggagagagtatggaaccacatcgtgcacttggaggaccatttattttgccagtatctttttagaaatgccctagaaatagcctctgaaattctccaaacccctgtcacggcatatgatctctacagtcacacatcaatttggttgttgcgaacggactttgttttggactatcccaaacccgtgatgcccaacatgatcttcattggtggtatcaactgtcatcagggaaagccattgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaa

SEQ ID NO: 197885 - DNA, 2065 bp, Homo sapiens
  Payload ID: 19023
  Gene Name: UDP glucuronosyltransferase 1 family, polypeptide A10
  Uniprot ID: Q9HAW8
  ENST ID: ENST00000373445
  CDS Start-End: 22-1347
ggctcgggctgcagttctctcatggctcgcgcagggtggaccagccccgttcctttatgtgtgtgtctactgctgacctgtggctttgccgaggcagggaagctgctggtagtgcccatggatgggagtcactggttcaccatgcagtcggtggtggagaaacttatcctcagggggcatgaggtggttgtagtcatgccagaggtgagttggcaactggaaagatcactgaattgcacagtgaagacttactcaacctcgtacactctggaagatcagaaccgggaattcatggttttcgcccatgctcaatggaaagcacaggcacaaagtatattttctctattaatgagttcatccagtggttttcttgacttatttttttcgcattgcaggagtttgtttaatgaccgaaaattagtagaatacttaaaggagagttcttttgatgcagtgtttctggatccttttgatacctgtggcttaattgttgctaaatatttctccctcccctctgtggtcttcaccaggggaatattttgccaccatcttgaagaaggtgcacagtgccctgctcctctttcctatgtccccaatgatctcttagggttctcagatgccatgactttcaaggagagagtatggaaccacatcgtgcacttggaggaccatttattttgccagtatctttttagaaatgccctagaaatagcctctgaaattctccaaacccctgtcacggcatatgatctctacagtcacacatcaatttggttgttgcgaacggactttgttttggactatcccaaacccgtgatgcccaacatgatcttcattggtggtatcaactgtcatcagggaaagccattgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagaaagaagcagcagtcaggaagacagatgtgaagagctggagcatgttcagatgagaggagacggaacacggggacacaccagcttgagcaagggacaacaggggaggactgatgactgacttcccacctttgaggtgctaatgtgtgtgtggtggcactggataaaagatcaatgttggctaggcaccatggcacacgcctgtagtcccagccactctggaggctaaggcgggaggattgcttgagcccagaagttggaggctgctatgagccgtgatcatgccactgcactccagcaacctgggcaacagagtgagaccctgtctcaaaaaaaaaaaaaaaaatgaaaagtccacataacctgagcatcatgtgcccagagcgttgggtggtgtggtcccattccttccttccagcggcttcttctggccacctcaatgtcaggatgtcctgctcacatatcaataccattaaaacctgacttctttccctgcactgttgaagctccttcttgaggctcacattatggatataattttgattctttcttcagtggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgattccaacactctgagctggggatagtgcctacacaaaataa

SEQ ID NO: 197886 - DNA, 2364 bp, Homo sapiens
  Payload ID: 19024
  Gene Name: UDP glucuronosyltransferase 1 family, polypeptide A3
  Uniprot ID: P35503
  ENST ID: ENST00000482026
  CDS Start-End: 20-1624
gtccgtgtcttctgctgagatggccacaggactccaggttcccctgccgtggctggccacaggactgctgcttctcctcagtgtccagccctgggctgagagtggaaaggtgttggtggtgcccattgatggcagccactggctcagcatgcgggaggtcttgcgggagctccatgccagaggccaccaggcagtggtcctcaccccagaggtgaatatgcacatcaaagaagagaactttttcaccctgacaacctatgccatttcgtggacccaggatgaatttgatcgccatgtgctgggccacactcaactgtactttgaaacagaacattttctgaagaaatttttcagaagtatggcaatgttgaacaatatgtctttggtctatcataggtcttgtgtggagctactacataatgaggccctgatcaggcacctgaatgctacttcctttgatgtggttttaacagaccccgttaacctctgcgcggcagtgctggctaagtacctgtcgattcctactgtgttttttttgaggaacattccatgtgatttagactttaagggcacacagtgtccaaacccttcctcctatattcctagattactaacaaccaattcagaccacatgacattcatgcaaagggtcaagaacatgctctaccctctggccctgtcctacatttgccatgctttttctgctccttatgcaagccttgcctctgagctttttcagagagaggtgtcagtggtggatattctcagtcatgcatctgtgtggctgttccgaggggactttgtgatggactaccccaggccaatcatgcccaacatggtcttcattgggggcatcaactgtgccaacaggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 197887 - DNA, 2388 bp, Homo sapiens
  Payload ID: 19025
  Gene Name: UDP glucuronosyltransferase 1 family, polypeptide A4
  Uniprot ID: P22310
  ENST ID: ENST00000373409
  CDS Start-End: 44-1648
acagcgtggggtggacagtcagctgtcggtggcttctgctgagatggccagaggactccaggttcccctgccgcggctggccacaggactgctgctcctcctcagtgtccagccctgggctgagagtggaaaggtgttggtggtgcccactgatggcagcccctggctcagcatgcgggaggccttgcgggagctccatgccagaggccaccaggcggtggtcctcaccccagaggtgaatatgcacatcaaagaagagaaatttttcaccctgacagcctatgctgttccatggacccagaaggaatttgatcgcgttacgctgggctacactcaagggttctttgaaacagaacatcttctgaagagatattctagaagtatggcaattatgaacaatgtatctttggcccttcataggtgttgtgtggagctactgcataatgaggccctgatcaggcacctgaatgctacttcctttgatgtggttttaacagaccccgttaacctctgtggggcggtgctggctaagtacctgtcgattcctgctgtgtttttttggaggtacattccatgtgacttagactttaagggcacacagtgtccaaatccttcctcctatattcctaagttactaacgaccaattcagaccacatgacattcctgcaaagggtcaagaacatgctctaccctctggccctgtcctacatttgccatactttttctgccccttatgcaagtcttgcctctgagctttttcagagagaggtgtcagtggtggatcttgtcagctatgcatccgtgtggctgttccgaggggactttgtgatggactaccccaggccgatcatgcccaacatggtcttcattgggggcatcaactgtgccaacgggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 197888 - DNA, 2186 bp, Homo sapiens
  Payload ID: 19025
  Gene Name: UDP glucuronosyltransferase 1 family, polypeptide A4
  Uniprot ID: P22310
  ENST ID: ENST00000450233
  CDS Start-End: 1-1338
atggccagaggactccaggttcccctgccgcggctggccacaggactgctgctcctcctcagtgtccagccctgggctgagagtggaaaggtgttggtggtgcccactgatggcagcccctggctcagcatgcgggaggccttgcgggagctccatgccagaggccaccaggcggtggtcctcaccccagaggtgaatatgcacatcaaagaagagaaatttttcaccctgacagcctatgctgttccatggacccagaaggaatttgatcgcgttacgctgggctacactcaagggttctttgaaacagaacatcttctgaagagatattctagaagtatggcaattatgaacaatgtatctttggcccttcataggtgttgtgtggagctactgcataatgaggccctgatcaggcacctgaatgctacttcctttgatgtggttttaacagaccccgttaacctctgtggggcggtgctggctaagtacctgtcgattcctgctgtgtttttttggaggtacattccatgtgacttagactttaagggcacacagtgtccaaatccttcctcctatattcctaagttactaacgaccaattcagaccacatgacattcctgcaaagggtcaagaacatgctctaccctctggccctgtcctacatttgccatactttttctgccccttatgcaagtcttgcctctgagctttttcagagagaggtgtcagtggtggatcttgtcagctatgcatccgtgtggctgttccgaggggactttgtgatggactaccccaggccgatcatgcccaacatggtcttcattgggggcatcaactgtgccaacgggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagaaagaagcagcagtcaggaagacagatgtgaagagctggagcatgttcagatgagaggagacggaacacggggacacaccagcttgagcaagggacaacaggggaggactgatgactgacttcccacctttgagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttca

SEQ ID NO: 197889 - DNA, 2345 bp, Homo sapiens
  Payload ID: 19026
  Gene Name: UDP glucuronosyltransferase 1 family, polypeptide A5
  Uniprot ID: P35504
  ENST ID: ENST00000373414
  CDS Start-End: 1-1605
atggccacaggactccaggttcccctgccgcagctggccacaggactgctgcttctcctcagtgtccagccctgggctgagagtgggaaggtgctggtggtgcccactgatggcagccactggctcagcatgcgggaggccttgcgggacctccatgcgagaggccaccaggtggtggtcctcaccctggaggtgaatatgtacatcaaagaagagaactttttcaccctgacaacgtatgccatttcatggacccaggacgaatttgatcgccttttgctgggtcacactcaatcgttctttgaaacagaacatcttctgatgaaattttctagaagaatggcaattatgaacaatatgtctttgatcatacataggtcttgtgtggagctactgcataatgaggccctgatcaggcacctgcatgctacttcctttgatgtggttctaacagacccctttcacctctgcgcggcggtgctggctaagtacctgtcgattcctgctgtgtttttcttgaggaacattccatgtgatttagactttaagggcacacagtgtccaaacccttcctcctatattcctagattactaacgaccaattcagaccacatgacattcctgcaaagggtcaagaacatgctctaccctctggccctgtcctacctttgccatgctgtttctgctccttatgcaagccttgcctctgagctttttcagagagaggtgtcagtggtggatcttgtcagccatgcatctgtgtggctgttccgaggggactttgtgatggattaccccaggccgatcatgcccaacatggtcttcattgggggcatcaactgtgccaacgggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 197890 - DNA, 2479 bp, Homo sapiens
  Payload ID: 19027
  Gene Name: UDP glucuronosyltransferase 1 family, polypeptide A6
  Uniprot ID: P19224
  ENST ID: ENST00000305139
  CDS Start-End: 140-1738
aaagggtaaaattcagagcaagggagaggtagacaggacctgtgaaaagcagtggttagtttagggaaaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 197891 - DNA, 1128 bp, Homo sapiens
  Payload ID: 19027
  Gene Name: UDP glucuronosyltransferase 1 family, polypeptide A6
  Uniprot ID: P19224
  ENST ID: ENST00000373424
  CDS Start-End: 222-1019
gggaccgccctcagcagtgtggttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactggctagacttatacttctcaaatcttaatttcctaaaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttg

SEQ ID NO: 197892 - DNA, 785 bp, Homo sapiens
  Payload ID: 19027
  Gene Name: UDP glucuronosyltransferase 1 family, polypeptide A6
  ENST ID: ENST00000406651
  CDS Start-End: 115-645
gaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagaaagaagcagcagtcaggaagacagatgtgaagagctggagcatgttcagatgagaggagacggaacacggggacacaccagcttgagcaagggacaacaggggaggactgatgactgacttcccacctttgaggtgctaatgtgtgtgtggtggcactggataaaagatc

SEQ ID NO: 197893 - DNA, 745 bp, Homo sapiens
  Payload ID: 19027
  Gene Name: UDP glucuronosyltransferase 1 family, polypeptide A6
  ENST ID: ENST00000441351
  CDS Start-End: 179-745
agtgtgaccctccctttctgggcctcagttgagaaacctgaagctcaggagaggagtcactcccctggcagatgggtggctgggccagaagcagataccaggctttctgactcctgctctaggattctcaccacgtactggctagacttatacttctcaaatcttaatttcctaaaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtg

SEQ ID NO: 197894 - DNA, 832 bp, Homo sapiens
  Payload ID: 19027
  Gene Name: UDP glucuronosyltransferase 1 family, polypeptide A6
  ENST ID: ENST00000446481
  CDS Start-End: 119-649
ggcagatgggtggctgggccagaagcagataccaggctttctgactcctgctctaggattctcaccacgtactggctagacttatacttctcaaatcttaatttcctaaaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagaaagaagcagcagtcaggaagacagatgtgaagagctggagcatgttcagatgagaggagacggaacacggggacacaccagcttgagcaagggacaacaggggaggactgatgactgacttcccacctttgagttacaaggagaacatcatgcgcctctccagccttcacaaggaccgcccggtggagccgctggacctggccgtgttctggg

SEQ ID NO: 197895 - DNA, 567 bp, Homo sapiens
  Payload ID: 19027
  Gene Name: UDP glucuronosyltransferase 1 family, polypeptide A6
  ENST ID: ENST00000484784
  CDS Start-End: 1-204
ctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcagtagtgcccccacaaattatgcagcccgttctgttctggaggaaccattcttatcagaacttggtgctggattgacttggagaaaagcctggccataatcttcaggatgaaataaaggcctggatgaatggatacttcagtctctatgcagacttgcagaagactggagcctttggcattcagaagaggaattcagactgtgcaagatctgaggccaggctccagctccccaggtcctttggaatttgaagcctacattaatgcttctggagaacatggaattgtggttttctctttgggatcaatggtctcagaaattccagagaagaaagctatggcaattgctgatgctttgggcaaaatccct

SEQ ID NO: 197896 - DNA, 2333 bp, Homo sapiens
  Payload ID: 19028
  Gene Name: UDP glucuronosyltransferase 1 family, polypeptide A7
  Uniprot ID: Q9HAW7
  ENST ID: ENST00000373426
  CDS Start-End: 1-1593
atggctcgtgcagggtggactggcctccttcccctatatgtgtgtctactgctgacctgtggctttgccaaggcagggaagctgctggtagtgcccatggatgggagccactggttcaccatgcagtcggtggtggagaaactcatcctcagggggcatgaggtggtcgtagtcatgccagaggtgagttggcaactgggaagatcactgaattgcacagtgaagacttactcaacctcatacactctggaggatcaggaccgggagttcatggtttttgccgatgctcgctggacggcaccattgcgaagtgcattttctctattaacaagttcatccaatggtatttttgacttatttttttcaaattgcaggagtttgtttaatgaccgaaaattagtagaatacttaaaggagagttgttttgatgcagtgtttctcgatccttttgatgcctgtggcttaattgttgccaaatatttctccctcccctctgtggtcttcgccaggggaatattttgccactatcttgaagaaggtgcacagtgccctgctcctctttcctatgtccccagacttctcttagggttctcagacgccatgactttcaaggagagagtatggaaccacatcatgcacttggaggaacatttattttgcccctattttttcaaaaatgtcttagaaatagcctctgaaattctccaaacccctgtcacggcatatgatctctacagccacacatcaatttggttgttgcgaactgactttgttttggagtatcccaaacccgtgatgcccaatatgatcttcattggtggtatcaactgtcatcagggaaagccagtgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 197897 - DNA, 2259 bp, Homo sapiens
  Payload ID: 19028
  Gene Name: UDP glucuronosyltransferase 1 family, polypeptide A7
  ENST ID: ENST00000485022
  CDS Start-End: 1-473
cagtgtttctcgatccttttgatgcctgtggcttaattgttgccaaatatttctccctcccctctgtggtcttcgccaggggaatattttgccactatcttgaagaaggtgcacagtgccctgctcctctttcctatgtccccagacttctcttagggttctcagacgccatgactttcaaggagagagtatggaaccacatcatgcacttggaggaacatttattttgcccctattttttcaaaaatgtcttagaaatagcctctgaaattctccaaacccctgtcacggcatatgatctctacagccacacatcaatttggttgttgcgaactgactttgttttggagtatcccaaacccgtgatgcccaatatgatcttcattggtggtatcaactgtcatcagggaaagccagtgcctatgggccaggatctacttctttcaccccactggaatatgtcccaagcctgagtcattcagcctgcagcaatccctgagaaaaaaaaaaaatcggcctttgcctggacactcaagtgatacctgaggacaccttgactcctacagcaccaaccagggcaggcctgggtctccagcggagctactctttagggatcgtcattatgacgaacagacatgccagattcctctggctagtgtccagtgcagacatacacacacacacacatacacacacacacacacacacacaccattcttagtacagtcaaagctcacaggagaaagaaaaatgttttctaataccttcttaatttgcaagaaggtgttaggaattcaagggatggtatgcatagtgatgttagtttcatttcttcagctccttcctccaactcatgttctgtagggacttctgggactaagaacaggacccacatatgagcaacaggattttcagagcaaggctgtggttggaagggctcagaccaacgtccacagcagagtggaggtctagtataaagaatgtgaagtttgtagcatctcttgatcccgctattcctacatgcttgcttaagccattcttcctctagatgaactgttctttgaaggaaacctgcctaatgtctgcctgctcaagaaggtggacctgagctctgttccctttgcaaccttcctggagtcttattgctatctagatgaactcaaagcaagatgctgccgcccccatgactttgatcattgtaagctgccaatcctcttgggaggctgctcccagcttggactgagctgagtcttcgcatgccttgaacaatgaatttgcatcctggttatgttccccatgggggccagccctgtccttggagtggcccctctaatcatgttgctcaggcttcttctcccttcctgggccccagaacacctccggtgccaaacttgtgggtgggaacaggaactcgcgtgccagccaggtgtgcatgactagctctgggcaagtctgttctagtaattcaaggtaccacctctcactgggacagcctagtttctacacaggtcttgctctgggaccgccctcagcagtgtggttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactggctagacttatacttctcaaatcttaatttcctaaaggcaagtaacagtttgaatgttgttatattgtgatgtataataagaaatatatgtttgtctttgtttcctggacacagctcctgaaaccataagtggtgggagcgataaacgtgaacaaagaatcttttgttattcaaaacagatccctttcgatcacacctaagtttatgtaaaggagatgtaaagtctctaaggatgagggctagttgccagggaacaaaacccttgcgattagagggaagaaaggagagagagattgaagattgatttgatcaccgatgggcaacaatctaatcaatcatgcctactatgtatggaagcctacataaaaactcagaagggcagggttcagagagctttcaggttgctgaaggtgtggagggtggggcacccagagatggcagatggggctccatggccatacccccatatcttgttctttgtactttttcctctggctattcatccgtattgtttgcaatatcctttgtaataaaccaaacctagtaaataaactgttttcttca

SEQ ID NO: 197898 - DNA, 2407 bp, Homo sapiens
  Payload ID: 19029
  Gene Name: UDP glucuronosyltransferase 1 family, polypeptide A8
  Uniprot ID: Q9HAW9
  ENST ID: ENST00000373450
  CDS Start-End: 64-1656
cttccgcctactgtatcatagcagcttagaatcccagctgctggctcgggctgcagttctctcatggctcgcacagggtggaccagccccattcccctatgtgtttctctgctgctgacctgtggctttgctgaggcagggaagctgctggtagtgcccatggatgggagtcactggttcaccatgcagtcggtggtggagaaacttatcctcagggggcatgaggtggttgtagtcatgccagaggtgagttggcaactgggaaaatcactgaattgcacagtgaagacttactcaacctcatacactctggaggatctggaccgggaattcatggatttcgccgatgctcaatggaaagcacaagtacgaagtttgttttctctatttctgagttcatccaatggtttttttaacttatttttttcgcattgcaggagtttgtttaatgaccgaaaattagtagaatacttaaaggagagttcttttgatgcggtgtttcttgatccttttgatgcctgtggcttaattgttgccaaatatttctccctcccctctgtggtcttcgccaggggaatagcttgccactatcttgaagaaggtgcacagtgccctgctcctctttcctatgtccccagaattctcttagggttctcagatgccatgactttcaaggagagagtacggaaccacatcatgcacttggaggaacatttattttgccagtatttttccaaaaatgccctagaaatagcctctgaaattctccaaacacctgtcacagcatatgatctctacagccacacatcaatttggttgttgcgaacagactttgttttggactatcccaaacccgtgatgcccaatatgatcttcattggtggtatcaactgccatcagggaaagccattgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgtt

SEQ ID NO: 197899 - DNA, 2416 bp, Homo sapiens
  Payload ID: 19030
  Gene Name: UDP glucuronosyltransferase 1 family, polypeptide A9
  Uniprot ID: O60656
  ENST ID: ENST00000354728
  CDS Start-End: 83-1675
ggttttgtgctggtatttctcccacctactgtatcataggagcttagattcccagctgcttgctctcagctgcagttctctgatggcttgcacagggtggaccagcccccttcctctatgtgtgtgtctgctgctgacctgtggctttgccgaggcagggaagctactggtagtgcccatggatgggagccactggttcaccatgaggtcggtggtggagaaactcattctcagggggcatgaggtggttgtagtcatgccagaggtgagttggcaactgggaagatcactgaattgcacagtgaagacttattcaacttcatataccctggaggatctggaccgggagttcaaggcttttgcccatgctcaatggaaagcacaagtacgaagtatatattctctattaatgggttcatacaatgacatttttgacttatttttttcaaattgcaggagtttgtttaaagacaaaaaattagtagaatacttaaaggagagttcttttgatgcagtgtttctcgatccttttgataactgtggcttaattgttgccaaatatttctccctcccctccgtggtcttcgccaggggaatactttgccactatcttgaagaaggtgcacagtgccctgctcctctttcctatgtccccagaattctcttagggttctcagatgccatgactttcaaggagagagtacggaaccacatcatgcacttggaggaacatttattatgccaccgttttttcaaaaatgccctagaaatagcctctgaaattctccaaacacctgttacggagtatgatctctacagccacacatcaatttggttgttgcgaacggactttgttttggactatcccaaacccgtgatgcccaacatgatcttcattggtggtatcaactgccatcagggaaagccgttgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 197900 - DNA, 1698 bp, Homo sapiens
  Payload ID: 19031
  Gene Name: UDP glucuronosyltransferase 2 family, polypeptide A1, complex locus
  Uniprot ID: Q9Y4X1
  ENST ID: ENST00000286604
  CDS Start-End: 115-1698
acattcggcttcttcctaatgtcaaatgagtgctgttaaagttcctccaggaaacttcagcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatataaggtgccctttggcaaagaaagaatagaaggagtaattaaggacttcgttttgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatagtagctttaaaacttggaattccatttatgtactccttgaggttttctccagcctcaacagtggaaaagcactgtgggaaggtaccataccctccttcctatgttcctgctgttttatcagaactcaccgaccaaatgtctttcactgacagaataagaaatttcatctcctaccacctacaggactacatgtttgaaactctttggaaatcatgggattcatactatagtaaagctttaggtggactcttactctgttgcccaggctggagtgcagtggcggatcttggctcactgcaacctctgcttcccgggttcaagcgattctcccgcctcagcctccattgtagttgggattacaggctgccagcaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaatag

SEQ ID NO: 197901 - DNA, 2519 bp, Homo sapiens
  Payload ID: 19031
  Gene Name: UDP glucuronosyltransferase 2 family, polypeptide A1, complex locus
  ENST ID: ENST00000512704
  CDS Start-End: 118-1569
ggatattaatggtttgcctcaaaattgagaaataattttgtctttcctttttttctttaaaagcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatataaggtgccctttggcaaagaaagaatagaaggagtaattaaggacttcgttttgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatagtagctttaaaacttggaattccatttatgtactccttgaggttttctccagcctcaacagtggaaaagcactgtgggaaggtaccataccctccttcctatgttcctgctgttttatcagaactcaccgaccaaatgtctttcactgacagaataagaaatttcatctcctaccacctacaggactacatgtttgaaactctttggaaatcatgggattcatactatagtaaagctttaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatatttttaagtttggcaaaatcctgagtagtgtagtcctattaattccagacaaaaggagtttaacaaaaacacgtctcccatcctgtttccaaattttctatttctctacctgcgataagcctactgataaagcctagattttggcatgattattattaacttgtgagttatagtcttctatttttcctttgtctctccctgctgactataccctcttcctgtcacttttctgacacaaggatactacctaattttaaatatgttctattcatagtatcaaattattttatcgttaaccttaattaatgattaacaatatgctgaatcctggtaatgcatacagtgtagatggaatttgataggtgtaaggaagagtcaaattcacaaatttccatataccaaacaaatcagggagccaccgtaggagagtagtgtgttatgagaaaggtaatgatttccttttttaataaaaacaaactcttctgcttgctcaatgtttcaggagttagagaatgaattttaagtgtgacgtgcgtccctattaaatgtctacaaaattttcattaagcatatctagaaaatcacggcataacttgcctgcctttcttcaacatatattcttatataacctgtagtggaagatttgggtactgtctttaataaatcaatcaatcgactcttttatttcaaggagaaagttctatgttatatgttgaaggtgaacagatcatatttagaggatataacaattagaaatctagaaaataattatcatttttataaaatttttagtcaactgtacaaataattacataaaacatcaattaattatgcttaaaaatcactaatgttcataatatataatcactatttgtaatcaaaagtttaattttatgccaaaaaataaaaaatgcttacttggaa

SEQ ID NO: 197902 - DNA, 2595 bp, Homo sapiens
  Payload ID: 19031
  Gene Name: UDP glucuronosyltransferase 2 family, polypeptide A1, complex locus
  Uniprot ID: Q9Y4X1
  ENST ID: ENST00000503640
  CDS Start-End: 57-1640
agcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatataaggtgccctttggcaaagaaagaatagaaggagtaattaaggacttcgttttgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatagtagctttaaaacttggaattccatttatgtactccttgaggttttctccagcctcaacagtggaaaagcactgtgggaaggtaccataccctccttcctatgttcctgctgttttatcagaactcaccgaccaaatgtctttcactgacagaataagaaatttcatctcctaccacctacaggactacatgtttgaaactctttggaaatcatgggattcatactatagtaaagctttaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggaaatggaagaatttatccagagctcaggtaaaaatggtgttgtggtgttttctctgggatcaatggtcaaaaaccttacagaagaaaaggccaatcttattgcctcagcccttgcccagattccacagaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatatttttaagtttggcaaaatcctgagtagtgtagtcctattaattccagacaaaaggagtttaacaaaaacacgtctcccatcctgtttccaaattttctatttctctacctgcgataagcctactgataaagcctagattttggcatgattattattaacttgtgagttatagtcttctatttttcctttgtctctccctgctgactataccctcttcctgtcacttttctgacacaaggatactacctaattttaaatatgttctattcatagtatcaaattattttatcgttaaccttaattaatgattaacaatatgctgaatcctggtaatgcatacagtgtagatggaatttgataggtgtaaggaagagtcaaattcacaaatttccatataccaaacaaatcagggagccaccgtaggagagtagtgtgttatgagaaaggtaatgatttccttttttaataaaaacaaactcttctgcttgctcaatgtttcaggagttagagaatgaattttaagtgtgacgtgcgtccctattaaatgtctacaaaattttcattaagcatatctagaaaatcacggcataacttgcctgcctttcttcaacatatattcttatataacctgtagtggaagatttgggtactgtctttaataaatcaatcaatcgactcttttatttcaaggagaaagttctatgttatatgttgaaggtgaacagatcatatttagaggatataacaattagaaatctagaaaataattatcatttttataaaatttttagtcaactgtacaaataattacataaaacatcaattaattatgcttaaaaatcactaatgttcataatatataatcactatttgtaatcaaaagtttaattttatgccaaaaaataaaaaatgcttacttggaatttga

SEQ ID NO: 197903 - DNA, 2376 bp, Homo sapiens
  Payload ID: 19031
  Gene Name: UDP glucuronosyltransferase 2 family, polypeptide A1, complex locus
  Uniprot ID: Q9Y4X1
  ENST ID: ENST00000514019
  CDS Start-End: 117-2198
ttacattcggcttcttcctaatgtcaaatgagtgctgttaaagttcctccaggaaacttcagcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatataaggtgccctttggcaaagaaagaatagaaggagtaattaaggacttcgttttgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatagtagctttaaaacttggaattccatttatgtactccttgaggttttctccagcctcaacagtggaaaagcactgtgggaaggtaccataccctccttcctatgttcctgctgttttatcagaactcaccgaccaaatgtctttcactgacagaataagaaatttcatctcctaccacctacaggactacatgtttgaaactctttggaaatcatgggattcatactatagtaaagctttagatggtagccattggttaaatattaagattattctagaagagttgattcaaagaaatcacaatgtgactgtactggcttcatcagcaactctattcatcaactccaatcccgattctcctgtgaattttgaagtgatacctgtttcctacaagaagagcaatatagattccttaattgagcatatgataatgctgtggattgaccatagaccaactcctctcacaatatgggctttctacaaagaactaggaaaacttctagacactttctttcaaattaacatacaactctgtgatggtgtactaaagaacccaaagttgatggcaagacttcagaaaggtggttttgatgtgttggtagcagacccagtaacaatctgtggtgatcttgttgctctgaaattaggaattccatttatgtacacattgaggttctctccagcatcaacagtggagagacactgtgggaaaatcccagcaccagtctcctatgtaccggcagccttatcagagctcactgaccagatgacctttggtgaaaggattaaaaataccatatcttattctctgcaagactatatatttcagtcctactggggagaatggaattcatactatagcaaaattttaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatatttttaagtttggcaaaatcctgagtagtgtagtcctattaattccagacaaaaggagtttaacaaaaacacgtctcccatcctgtttccaaattttctatttctctacctgcgataagcctactgataaagcctagattttggcatgatta

SEQ ID NO: 197904 - DNA, 586 bp, Homo sapiens
  Payload ID: 19031
  Gene Name: UDP glucuronosyltransferase 2 family, polypeptide A1, complex locus
  ENST ID: ENST00000505512
  CDS Start-End: 112-586
acattcggcttcttcctaatgtcaaatgagtgctgttaaagttcctccaggaaacttcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatataaggtgccctttggcaaagaaagaatagaaggagtaattaaggacttcgttttgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatag

SEQ ID NO: 197905 - DNA, 1544 bp, Homo sapiens
  Payload ID: 19032
  Gene Name: UDP glucuronosyltransferase 2 family, polypeptide A2
  Uniprot ID: Q9Y4X1
  ENST ID: ENST00000604021
  CDS Start-End: 3-1481
ggatggtttccataagggattttaccatgcctaagaagtttgtccagatgctggtttttaatttgactctgactgaagttgttctaagtgggaatgtgttaatttggcctacagatggtagccattggttaaatattaagattattctagaagagttgattcaaagaaatcacaatgtgactgtactggcttcatcagcaactctattcatcaactccaatcccgattctcctgtgaattttgaagtgatacctgtttcctacaagaagagcaatatagattccttaattgagcatatgataatgctgtggattgaccatagaccaactcctctcacaatatgggctttctacaaagaactaggaaaacttctagacactttctttcaaattaacatacaactctgtgatggtgtactaaagaacccaaagttgatggcaagacttcagaaaggtggttttgatgtgttggtagcagacccagtaacaatctgtggtgatcttgttgctctgaaattaggaattccatttatgtacacattgaggttctctccagcatcaacagtggagagacactgtgggaaaatcccagcaccagtctcctatgtaccggcagccttatcagagctcactgaccagatgacctttggtgaaaggattaaaaataccatatcttattctctgcaagactatatatttcagtcctactggggagaatggaattcatactatagcaaaattttaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatatttttaagtttggcaaaatcctgagtagtgtagtcct

SEQ ID NO: 197906 - DNA, 1676 bp, Homo sapiens
  Payload ID: 19032
  Gene Name: UDP glucuronosyltransferase 2 family, polypeptide A2
  Uniprot ID: Q9Y4X1
  ENST ID: ENST00000604629
  CDS Start-End: 3-1613
ggatggtttccataagggattttaccatgcctaagaagtttgtccagatgctggtttttaatttgactctgactgaagttgttctaagtgggaatgtgttaatttggcctacagatggtagccattggttaaatattaagattattctagaagagttgattcaaagaaatcacaatgtgactgtactggcttcatcagcaactctattcatcaactccaatcccgattctcctgtgaattttgaagtgatacctgtttcctacaagaagagcaatatagattccttaattgagcatatgataatgctgtggattgaccatagaccaactcctctcacaatatgggctttctacaaagaactaggaaaacttctagacactttctttcaaattaacatacaactctgtgatggtgtactaaagaacccaaagttgatggcaagacttcagaaaggtggttttgatgtgttggtagcagacccagtaacaatctgtggtgatcttgttgctctgaaattaggaattccatttatgtacacattgaggttctctccagcatcaacagtggagagacactgtgggaaaatcccagcaccagtctcctatgtaccggcagccttatcagagctcactgaccagatgacctttggtgaaaggattaaaaataccatatcttattctctgcaagactatatatttcagtcctactggggagaatggaattcatactatagcaaaattttaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggaaatggaagaatttatccagagctcaggtaaaaatggtgttgtggtgttttctctgggatcaatggtcaaaaaccttacagaagaaaaggccaatcttattgcctcagcccttgcccagattccacagaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatatttttaagtttggcaaaatcctgagtagtgtagtcct

SEQ ID NO: 197907 - DNA, 2965 bp, Homo sapiens
  Payload ID: 19033
  Gene Name: UDP glucuronosyltransferase 2 family, polypeptide A3
  Uniprot ID: Q6UWM9
  ENST ID: ENST00000251566
  CDS Start-End: 32-1615
ttgcagatcagtgtgtgagggaactgccatcatgaggtctgacaagtcagctttggtatttctgctcctgcagctcttctgtgttggctgtggattctgtgggaaagtcctggtgtggccctgtgacatgagccattggcttaatgtcaaggtcattctagaagagctcatagtgagaggccatgaggtaacagtattgactcactcaaagccttcgttaattgactacaggaagccttctgcattgaaatttgaggtggtccatatgccacaggacagaacagaagaaaatgaaatatttgttgacctagctctgaatgtcttgccaggcttatcaacctggcaatcagttataaaattaaatgatttttttgttgaaataagaggaactttaaaaatgatgtgtgagagctttatctacaatcagacgcttatgaagaagctacaggaaaccaactacgatgtaatgcttatagaccctgtgattccctgtggagacctgatggctgagttgcttgcagtcccttttgtgctcacacttagaatttctgtaggaggcaatatggagcgaagctgtgggaaacttccagctccactttcctatgtacctgtgcctatgacaggactaacagacagaatgacctttctggaaagagtaaaaaattcaatgctttcagttttgttccacttctggattcaggattacgactatcatttttgggaagagttttatagtaaggcattaggaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctggcctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccacgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatgattattcctggtgtgcgcccaaacacatggatataaagaggtaaaaaacttaaaattcacaaaattcagtaaaccacacaaatcaggtaagtgttctatgagattagctggctatgagaaacataatgatgtttctttttcaatttaaataagcccttctacatagccagcatcagtgatctcagaaaataaattgctaataatgatgacatggcattatgcttagaaaagtttgctgtatttccatagacctcatctagatgtcatggcctacatttctgccatcactcaaccaatacttttttctgttttcttgatgataaaaagacctttctcatgattgccatcaaataacaaaagaaactattttttttctcacatagagaacatgtcagtaagatattcaaggtgaacagattatttttgggattagtaactatttgaaatatgtggtgataattactgagtttataaaatttatttgatagtacacttaaagaagatttatatgtttattctttaaaaatgatgaatactcataattcttatctctataatcaaaagtataatttactgtagaaaaataaagagatgcttgttctgaaagtaagatcagtgaactgcttttcagtctcaatctttgagaattgtaaattcatcaaataattgcttacatagtaaaaatttaaggtattagaaaacctgcataacaaatagtattatatattaaatattttgatatgtaaagctctacacaaagctaaatatagtgtaataatgtttacactaataagcaaatatgttaatcttctcatttttttactgtcatataatcttagtgatatgcctattaatagttttaaataaataaattggctcatctggctttttgaaaattttgaaattcttacagatgttgattaggtatatctacaaattaatttcaattttaaaatgatgatataaaaataaatataagtatttttcttgtgtatgtatacaataaatataaataaaattgtttactgttttgaaa

SEQ ID NO: 197908 - DNA, 1645 bp, Homo sapiens
  Payload ID: 19033
  Gene Name: UDP glucuronosyltransferase 2 family, polypeptide A3
  ENST ID: ENST00000503012
  CDS Start-End: 4-522
cttatgaagaagctacaggaaaccaactacgatgtaatgcttatagaccctgtgattccctgtggagacctgatggctgagttgcttgcagtcccttttgtgctcacacttagaatttctgtaggaggcaatatggagcgaagctgtgggaaacttccagctccactttcctatgtacctgtgcctatgacaggactaacagacagaatgacctttctggaaagagtaaaaaattcaatgctttcagttttgttccacttctggattcaggattacgactatcatttttgggaagagttttatagtaaggcattaggaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaagttataccagaaaaccaagctctcttaagccatggcatctgtatctaaaatagaaatacagaaggagagctgacaatttccatcattctctaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctggcctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccacgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatgattattcctggtgtgcgcccaaacacatggatataaagaggtaaaaaac

SEQ ID NO: 197909 - DNA, 2965 bp, Homo sapiens; identical to SEQ ID NO: 197907
  Payload ID: 19033
  Gene Name: UDP glucuronosyltransferase 2 family, polypeptide A3
  Uniprot ID: Q6UWM9
  ENST ID: ENST00000611042
  CDS Start-End: 32-1615

SEQ ID NO: 197910 - DNA, 1645 bp, Homo sapiens; identical to SEQ ID NO: 197908
  Payload ID: 19033
  Gene Name: UDP glucuronosyltransferase 2 family, polypeptide A3
  ENST ID: ENST00000626124
  CDS Start-End: 1-522

SEQ ID NO: 197911 - DNA, 1931 bp, Homo sapiens
  Payload ID: 19034
  Gene Name: UDP glucuronosyltransferase 2 family, polypeptide B10
  Uniprot ID: P36537
  ENST ID: ENST00000265403
  CDS Start-End: 28-1614
ggaaaagaattatcacattgcacaaggatggctctgaaatggactacagttctgctgatacaactcagtttttactttagctctgggagttgtggaaaggtgctggtatgggccgcagaatacagcctttggatgaatatgaagacaatcctgaaagaacttgttcagagaggtcatgaggtgactgtactggcatcttcagcttccattctttttgatcccaacgactcatccactcttaaacttgaagtttatcctacatctttaactaaaactgaatttgagaatatcatcatgcaattggttaagagattgtcagaaattcaaaaagatacattttggttacctttttcacaagaacaagaaatcctgtgggcaattaatgacataattagaaacttctgtaaagatgtagtttcaaataagaaacttatgaaaaaactacaagagtcaagatttgacatcgtttttgcagatgcttatttaccctgtggtgagctgctggctgagctatttaacataccctttgtgtacagtcacagcttcagtcctggctactcatttgaaaggcacagtggaggatttattttccctccttcctacgtacctgttgttatgtcaaaattaagtgatcaaatgactttcatggagagggtaaaaaatatgctctatgtgctttattttgacttttggttccaaatatttaatatgaagaagtgggatcagttttacagtgaagttttaggaagacccactacattatctgagacaatgaggaaagctgacatatggcttatgcgaaactcctggaattttaaatttcctcatccattcttaccaaatgttgattttgttggaggactccactgcaaacctgccaaacccctacctaaggaaatggaggagtttgtacagagctctggagaaaatggtgttgtggtgttttctctggggtcaatggtcagtaacatgacagaagaaagggccaacgtaattgcaacagcccttgccaagatcccacaaaaggttctttggagatttgatgggaataaaccagatgccttaggtctcaatactcgactgtacaagtggataccccagaatgaccttctaggtcatccaaaaaccagagcttttataactcatggtggagccaatggcatctatgaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagataggaatacttcagttgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatgagcttgtattgaaatttgttgcacttatattgaaatgtgatcatggctcacttcagcctcaacttactaagctcaaga

SEQ ID NO: 197912 - DNA, 1424 bp, Homo sapiens
  Payload ID: 19034
  Gene Name: UDP glucuronosyltransferase 2 family, polypeptide B10
  Uniprot ID: P36537
  ENST ID: ENST00000458688
  CDS Start-End: 26-1360
aaaagaattatcacattgcacaaggatggctctgaaatggactacagttctgctgatacaactcagtttttactttagctctgggagttgtggaaaggtgctggtatgggccgcagaatacagcctttggatgaatatgaagacaatcctgaaagaacttgttcagagaggtcatgaggtgactgtactggcatcttcagcttccattctttttgatcccaacgactcatccactcttaaacttgaagtttatcctacatctttaactaaaactgaatttgagaatatcatcatgcaattggttaagagattgtcagaaattcaaaaagatacattttggttacctttttcacaagaacaagaaatcctgtgggcaattaatgacataattagaaacttctgtaaagatgtagtttcaaataagaaacttatgaaaaaactacaagagtcaagatttgacatcgtttttgcagatgcttatttaccctgtggaagacccactacattatctgagacaatgaggaaagctgacatatggcttatgcgaaactcctggaattttaaatttcctcatccattcttaccaaatgttgattttgttggaggactccactgcaaacctgccaaacccctacctaaggaaatggaggagtttgtacagagctctggagaaaatggtgttgtggtgttttctctggggtcaatggtcagtaacatgacagaagaaagggccaacgtaattgcaacagcccttgccaagatcccacaaaaggttctttggagatttgatgggaataaaccagatgccttaggtctcaatactcgactgtacaagtggataccccagaatgaccttctaggtcatccaaaaaccagagcttttataactcatggtggagccaatggcatctatgaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagataggaatacttcagttgattccagcaat

SEQ ID NO: 197913 - DNA, 1931 bp, Homo sapiens; identical to SEQ ID NO: 197911
  Payload ID: 19034
  Gene Name: UDP glucuronosyltransferase 2 family, polypeptide B10
  Uniprot ID: P36537
  ENST ID: ENST00000615213
  CDS Start-End: 28-1614

SEQ ID NO: 197914 - DNA, 1424 bp, Homo sapiens; identical to SEQ ID NO: 197912
  Payload ID: 19034
  Gene Name: UDP glucuronosyltransferase 2 family, polypeptide B10
  Uniprot ID: P36537
  ENST ID: ENST00000627047
  CDS Start-End: 26-1360

SEQ ID NO: 197915 - DNA, 2088 bp, Homo sapiens
  Payload ID: 19035
  Gene Name: UDP glucuronosyltransferase 2 family, polypeptide B11
  Uniprot ID: O75310
  ENST ID: ENST00000446444
  CDS Start-End: 10-1599
tgcaccaggatgactctgaaatggacttcagttcttctgctgatacatctcagttgttactttagctctgggagttgtggaaaagtgctggtgtgggccgcagaatacagccattggatgaatatgaagacaatcctgaaagagcttgttcagagaggtcatgaggtgactgtactggcatcttcagcttccattctttttgatcccaatgatgcatccactcttaaatttgaagtttatcctacatctttaactaaaactgaatttgagaatatcatcatgcaacaggttaagagatggtcagacattcgaaaagatagcttttggttatatttttcacaagaacaagaaatcctgtgggaattatatgacatatttagaaacttctgtaaagatgtagtttcaaataagaaagttatgaaaaaactacaagagtcaagatttgacatcgtttttgcagatgctgtttttccctgtggtgagctgctggctgcgctacttaacatacggtttgtgtacagtctccgctttactcctggctacacaattgaaaggcacagtggaggactgattttccctccttcctacatacctattgttatgtcaaaattaagtgatcaaatgactttcatggagagggtaaaaaatatgatctatgtgctttattttgacttttggttccaaatgtctgatatgaagaagtgggatcagttttacagtgaagttttaggaagacccactaccttatttgagacaatgggaaaagctgacatatggcttatgcgaaactcctggagttttcaatttcctcatccattcttaccaaacgttgattttgttggaggattccactgcaaacctgccaaacccctacctaaggaaatggaggagtttgtacagagctctggagaaaatggtgttgtggtgttttctctggggtcagtgataagtaacatgacagcagaaagggccaatgtaattgcaacagcccttgccaagatcccacaaaaggttctgtggagatttgacgggaataaaccagatgccttaggtctcaatactcggctgtacaagtggataccccagaatgaccttctaggtcatccaaaaaccagagcttttataactcatggtggagccaatggcatctatgaggcaatctaccatgggatccctatggtgggcattccattgttttttgatcaacctgataacattgctcacatgaaggccaagggagcagctgttagattggacttcaacacaatgtcgagtacagacctgctgaatgcactgaagacagtaattaatgatcctttatataaagagaatattatgaaattatcaagaattcaacatgatcaaccagtaaagcccctggatcgagcagtcttctggattgaatttgtcatgccccacaaaggagccaaacaccttcgagttgcagcccatgacctcacctggttccagtaccactctttggatgtgattgggtttctgctggcctgtgtggcaactgtgatatttatcatcacaaagttttgtctgttttgtttctggaagtttgctagaaaagggaagaagggaaaaagagattagttatgtctgacatttgaagctggaaaaccagatagataggacaacttcagtttattccagcaagaaagaaaagattgttatgcaagatttctttcttcctgtgacaaaaaaaaaaaaaaaaaaaaaattttcaaatctaccttgtcaagtaaaaatttgtttttcagagatttaccacccaggtaatggttagaaatattttgtggcaatgaagaaaatactaggaaaattaaaaaataatataaagccatttgagctcatattgaaatttgttgcacttatattgagatttgttgtttgaattcacaagttacatgaaaaaatttactcagcttaactatatttcacacattttacataaacacaagaacattaagaagtctactgacagtatcagtagtcacatcctcagaataatttggcttcattttgaacaggattctgttgttttaactgttgctaaagaaactattacatagttaaattgta

SEQ ID NO: 197916 - DNA, 1833 bp, Homo sapiens
  Payload ID: 19035
  Gene Name: UDP glucuronosyltransferase 2 family, polypeptide B11
  Uniprot ID: O75310
  ENST ID: ENST00000615638
  CDS Start-End: 3-1592
ggatgactctgaaatggacttcagttcttctgctgatacatctcagttgttactttagctctgggagttgtggaaaagtgctggtgtgggccgcagaatacagccattggatgaatatgaagacaatcctgaaagagcttgttcagagaggtcatgaggtgactgtactggcatcttcagcttccattctttttgatcccaatgatgcatccactcttaaatttgaagtttatcctacatctttaactaaaactgaatttgagaatatcatcatgcaacaggttaagagatggtcagacattcgaaaagatagcttttggttatatttttcacaagaacaagaaatcctgtgggaattatatgacatatttagaaacttctgtaaagatgtagtttcaaataagaaagttatgaaaaaactacaagagtcaagatttgacatcgtttttgcagatgctgtttttccctgtggtgagctgctggctgcgctacttaacatacggtttgtgtacagtctccgctttactcctggctacacaattgaaaggcacagtggaggactgattttccctccttcctacatacctattgttatgtcaaaattaagtgatcaaatgactttcatggagagggtaaaaaatatgatctatgtgctttattttgacttttggttccaaatgtctgatatgaagaagtgggatcagttttacagtgaagttttaggaagacccactaccttatttgagacaatgggaaaagctgacatatggcttatgcgaaactcctggagttttcaatttcctcatccattcttaccaaacgttgattttgttggaggattccactgcaaacctgccaaacccctacctaaggaaatggaggagtttgtacagagctctggagaaaatggtgttgtggtgttttctctggggtcagtgataagtaacatgacagcagaaagggccaatgtaattgcaacagcccttgccaagatcccacaaaaggttctgtggagatttgacgggaataaaccagatgccttaggtctcaatactcggctgtacaagtggataccccagaatgaccttctaggtcatccaaaaaccagagcttttataactcatggtggagccaatggcatctatgaggcaatctaccatgggatccctatggtgggcattccattgttttttgatcaacctgataacattgctcacatgaaggccaagggagcagctgttagattggacttcaacacaatgtcgagtacagacctgctgaatgcactgaagacagtaattaatgatcctttatataaagagaatattatgaaattatcaagaattcaacatgatcaaccagtaaagcccctggatcgagcagtcttctggattgaatttgtcatgccccacaaaggagccaaacaccttcgagttgcagcccatgacctcacctggttccagtaccactctttggatgtgattgggtttctgctggcctgtgtggcaactgtgatatttatcatcacaaagttttgtctgttttgtttctggaagtttgctagaaaagggaagaagggaaaaagagattagttatgtctgacatttgaagctggaaaaccagatagataggacaacttcagtttattccagcaagaaagaaaagattgttatgcaagatttctttcttcctgtgacaaaaaaaaaaatcttttcgaaatctaccttgtcaagtaaaaatttgtttttcagagatttaccacccagttaatggttagaaatattttgtggcaatgaagaaaacactagggaaaataaaaaataacataaagcc

SEQ ID NO: 197917 - DNA, 1525 bp, Homo sapiens
  Payload ID: 19035
  Gene Name: UDP glucuronosyltransferase 2 family, polypeptide B11
  ENST ID: ENST00000620779
  CDS Start-End: 3-1010
ggatgactctgaaatggacttcagttcttctgctgatacatctcagttgttactttagctctgggagttgtggaaaagtgctggtgtgggccgcagaatacagccattggatgaatatgaagacaatcctgaaagagcttgttcagagaggtcatgaggtgactgtactggcatcttcagcttccattctttttgatcccaatgatgcatccactcttaaatttgaagtttatcctacatctttaactaaaactgaatttgagaatatcatcatgcaacaggttaagagatggtcagacattcgaaaagatagcttttggttatatttttcacaagaacaagaaatcctgtgggaattatatgacatatttagaaacttctgtaaagatgtagtttcaaataagaaagttatgaaaaaactacaagagtcaagatttgacatcgtttttgcagatgctgtttttccctgtggtgagctgctggctgcgctacttaacatacggtttgtgtacagtctccgctttactcctggctacacaattgaaaggcacagtggaggactgattttccctccttcctacatacctattgttatgtcaaaattaagtgatcaaatgactttcatggagagggtaaaaaatatgatctatgtgctttattttgacttttggttccaaatgtctgatatgaagaagtgggatcagttttacagtgaagttttaggaagacccactaccttatttgagacaatgggaaaagctgacatatggcttatgcgaaactcctggagttttcaatttcctcatccattcttaccaaacgttgattttgttggaggattccactgcaaacctgccaaacccctacctaaggaaatggaggagtttgtacagagctctggagaaaatggtgttgtggtgttttctctggggtcagtgataagtaacatgacagcagaaagggccaatgtaattgcaacagcccttgccaagatcccacaaaagatataaagagaatattatgaaattatcaagaattcaacatgatcaaccagtaaagcccctggatcgagcagtcttctggattgaatttgtcatgccccacaaaggagccaaacaccttcgagttgcagcccatgacctcacctggttccagtaccactctttggatgtgattgggtttctgctggcctgtgtggcaactgtgatatttatcatcacaaagttttgtctgttttgtttctggaagtttgctagaaaagggaagaagggaaaaagagattagttatgtctgacatttgaagctggaaaaccagatagataggacaacttcagtttattccagcaagaaagaaaagattgttatgcaagatttctttcttcctgtgacaaaaaaaaaaatcttttcgaaatctaccttgtcaagtaaaaatttgtttttcagagatttaccacccagttaatggttagaaatattttgtggcaatgaagaaaacactagggaaaataaaaaataacataaagcc

SEQ ID NO: 197918 - DNA, 2077 bp, Homo sapiens
  Payload ID: 19036
  Gene Name: UDP glucuronosyltransferase 2 family, polypeptide B15
  Uniprot ID: P54855
  ENST ID: ENST00000338206
  CDS Start-End: 11-1603
taagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaattatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttattttccagggatttaatacgtactttagctgaattattctatgtcaatgatttttaagctatgaaaaatacaatggggggaaggatagcatttggagatatacctaatgttaaatgacgagttactggatgcagcacgccaacatggcacatgtatacatatgtagctaacctgcacgttgtgcacatgtaccctaaaacttaaagtataatttaaaaaaagcaaaaaaaaaaaatacaactcttttttttaaaccaggaaggaaaatgtgaacatggaaacaacttctagtattggatctgaaaataaagtgtcatccaagccataaaaaaaaa

SEQ ID NO: 197919 - DNA, 2112 bp, Homo sapiens
  Payload ID: 19036
  Gene Name: UDP glucuronosyltransferase 2 family, polypeptide B15
  ENST ID: ENST00000611777
  CDS Start-End: 605-1603
taagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaatgatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttattttccagggatttaatacgtactttagctggaattattctatgtcaatgatttttaagctatgaaaaatacaatggggggaaggatagcatttggagatatacctaatgttaaatgacgagttactggatgcagcacgccaacatggcacatgtatacatatgtagctaacctgcacgttgtgcacatgtaccctaaaacttaaagtataatttaaaaaaagcaaaaaaaaaaaaatacaactcttttttttaaaccaggaaggaaaatgtgaacatggaaacaacttctagtattggatctgaaaataaagtgtcatccaagccataaaaaaaaaagaaaagaaaaataaaaataatataaaacctta

SEQ ID NO: 197920 - DNA, 1846 bp, Homo sapiens
  Payload ID: 19036
  Gene Name: UDP glucuronosyltransferase 2 family, polypeptide B15
  Uniprot ID: P54855
  ENST ID: ENST00000616841
  CDS Start-End: 1-1593
atgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaattatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttaaaaacgtcttttcacaacttaccctgttaagtcaaaatttattttccaggaatttaatatgtactttagttggaattattctatgtcaatgatttttaagctatgaaaaataat

SEQ ID NO: 197921 - DNA, 2077 bp, Homo sapiens
  Payload ID: 19037
  Gene Name: UDP glucuronosyltransferase 2 family, polypeptide B17
  Uniprot ID: O75795
  ENST ID: ENST00000317746
  CDS Start-End: 44-1636
gaaagaaacaacaactggaaaagaagcactgcataagaccaggatgtctctgaaatggatgtcagtctttctgctgatgcagctcagttgttactttagctctgggagttgtggaaaggtgctggtgtggcccacagaatacagccattggataaatatgaagacaatcctggaagagcttgttcagaggggtcatgaggtgattgtgttgacatcttcggcttctattcttgtcaatgccagtaaatcatctgctattaaattagaagtttatcctacatctttaactaaaaatgatttggaagatttttttatgaaaatgttcgatagatggacatatagtatttcaaaaaatacattttggtcatatttttcacaactacaagaattgtgttgggaatattctgactataatataaagctctgtgaagatgcagttttgaacaagaaacttatgagaaaactacaagagtcaaaatttgatgtccttctggcagatgccgttaatccctgtggtgagctgctggctgagctacttaacataccctttctgtacagtctccgcttctctgttggctacacagttgagaagaatggtggaggatttctgttccctccttcctatgtacctgttgttatgtcagaattaagtgatcaaatgattttcatggagaggataaaaaatatgatatatatgctttattttgacttttggtttcaagcatatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccttgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtataagtggttaccccagaatgaccttcttggtcatcccaaaaccaaagcttttataactcatggtggaaccaatggcatctatgaggcaatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctatctataaagagaatatcatgaaattatcaagaattcatcatgatcaaccggtgaagcccctggatcgagcagtcttctggattgagtttgtcatgcgccataaaggagccaagcaccttcgggtcgcagcccacaacctcacctggatccagtaccactctttggatgtgatagcattcctgctggcctgcgtggcaactatgatatttatgatcacaaaatgttgcctgttttgtttccgaaagcttgccaaaacaggaaagaagaagaaaagggattagttatatcaaaagcctgaagtggaatgaccaaaagatgggactcctcctttattccagcatggagggttttaaatggaggatttcctttttcctgcgacaaaacgtcttttcacaacttaccctgttaagtcaaaatttattttccaggaatttaatatgtactttagttggaattattctatgtcaatgatttttaagctatgaaaaataataatataaaaccttatgggcttatattgaaatttattattctaatccaaaagttaccccacacaaaagttactgagcttccttatgtttcacacattgtatttgaacacaaaacattaacaactccactcatagtatcaacattgttttgcaaatactcagaatattttggcttcattttgagcagaatttttgtttttaattttgccaatgaaatcttcaataattaaa

SEQ ID NO: 197922 - DNA, 1833 bp, Homo sapiens
  Payload ID: 19038
  Gene Name: UDP glucuronosyltransferase 2 family, polypeptide B28
  Uniprot ID: Q9BY64
  ENST ID: ENST00000335568
  CDS Start-End: 3-1592
ggatggctctgaagtggacttcagttcttctgctgatacatctcggttgttactttagctctgggagttgtggaaaggtgctggtgtggaccggtgaatacagccattggatgaatatgaagacaatcctgaaagagcttgttcagagaggtcatgaggtgactgtactggcatcttcagcttccattctttttgatcccaatgacgcattcactcttaaactcgaagtttatcctacatctttaactaaaactgaatttgagaatatcatcatgcaacaggttaagagatggtcagacattcaaaaagatagcttttggttatatttttcacaagaacaagaaatcctgtgggaatttcatgacatatttagaaacttctgtaaagatgtagtttcaaataagaaagttatgaaaaaactacaagagtcaagatttgacatcatttttgcagatgctttttttccttgtggtgagctgctggctgcgctacttaacataccgtttgtgtacagtctctgcttcactcctggctacacaattgaaaggcacagtggaggactgattttccctccttcctacatacctgttgttatgtcaaaattaagtgatcaaatgactttcatggagagggtaaaaaacatgatctatgtgctttattttgacttttggttccaaatgtgtgatatgaagaagtgggatcagttttacagtgaagttttaggaagacccactaccttatttgagacaatggggaaagctgacatatggcttatgcgaaactcctggagttttcaatttcctcatccattcttaccaaacattgattttgttggaggactccactgcaaacctgccaaacccctacctaaggaaatggaggaatttgtacagagctctggtgaaaatggtgttgtggtgttttctctggggtcagtgataagtaacatgacagcagaaagggccaacgtaattgcaacagcccttgccaagatcccacaaaaggttctgtggagatttgatgggaataaaccagatgccttaggtctcaatactcggctgtataagtggataccccagaatgaccttctaggtcttccaaaaaccagagcttttataactcatggtggagccaatggcatctatgaggcaatctaccatgggatccctatggtaggcattccattgttttgggatcaacctgataacattgctcacatgaaggccaagggagcagctgttagactggacttccacacaatgtcgagtacagacctgctgaatgcactgaagacagtaattaatgatccttcatataaagagaatgttatgaaattatcaataattcaacatgatcaaccagtaaagcccctgcatcgagcagtcttctggattgaatttgtgatgtgccacaaaggagccaaacaccttcgagttgcagcccgtgacctcacctggttccagtaccactctttggatgtgattgggtttctgctggcctgtgtggcaactgtgatatttgtcgtcacaaagttttgtctgttttgtttctggaagtttgctagaaaagggaagaagggaaaaagagattagttatgtctgacatttgaagctggaaaaccagatagatgggttgacatcagtttattccagcaagaaagaaaagattgttatgcaagatttctttcttcctgtgacaaaaaaaaaaacttttcaaaatctaccttgtcaagtaaaaatttgtttttcagagatttaccacccaggtaatggttagaaatattctgtggcaatgaagaaaacactagggaaaataaaaaataatataaagcca

SEQ ID NO: 197923 - DNA, 1525 bp, Homo sapiens
  Payload ID: 19038
  Gene Name: UDP glucuronosyltransferase 2 family, polypeptide B28
  Uniprot ID: Q9BY64
  ENST ID: ENST00000511240
  CDS Start-End: 3-1010
ggatggctctgaagtggacttcagttcttctgctgatacatctcggttgttactttagctctgggagttgtggaaaggtgctggtgtggaccggtgaatacagccattggatgaatatgaagacaatcctgaaagagcttgttcagagaggtcatgaggtgactgtactggcatcttcagcttccattctttttgatcccaatgacgcattcactcttaaactcgaagtttatcctacatctttaactaaaactgaatttgagaatatcatcatgcaacaggttaagagatggtcagacattcaaaaagatagcttttggttatatttttcacaagaacaagaaatcctgtgggaatttcatgacatatttagaaacttctgtaaagatgtagtttcaaataagaaagttatgaaaaaactacaagagtcaagatttgacatcatttttgcagatgctttttttccttgtggtgagctgctggctgcgctacttaacataccgtttgtgtacagtctctgcttcactcctggctacacaattgaaaggcacagtggaggactgattttccctccttcctacatacctgttgttatgtcaaaattaagtgatcaaatgactttcatggagagggtaaaaaacatgatctatgtgctttattttgacttttggttccaaatgtgtgatatgaagaagtgggatcagttttacagtgaagttttaggaagacccactaccttatttgagacaatggggaaagctgacatatggcttatgcgaaactcctggagttttcaatttcctcatccattcttaccaaacattgattttgttggaggactccactgcaaacctgccaaacccctacctaaggaaatggaggaatttgtacagagctctggtgaaaatggtgttgtggtgttttctctggggtcagtgataagtaacatgacagcagaaagggccaacgtaattgcaacagcccttgccaagatcccacaaaagatataaagagaatgttatgaaattatcaataattcaacatgatcaaccagtaaagcccctgcatcgagcagtcttctggattgaatttgtgatgtgccacaaaggagccaaacaccttcgagttgcagcccgtgacctcacctggttccagtaccactctttggatgtgattgggtttctgctggcctgtgtggcaactgtgatatttgtcgtcacaaagttttgtctgttttgtttctggaagtttgctagaaaagggaagaagggaaaaagagattagttatgtctgacatttgaagctggaaaaccagatagatgggttgacatcagtttattccagcaagaaagaaaagattgttatgcaagatttctttcttcctgtgacaaaaaaaaaaacttttcaaaatctaccttgtcaagtaaaaatttgtttttcagagatttaccacccaggtaatggttagaaatattctgtggcaatgaagaaaacactagggaaaataaaaaataatataaagcca

SEQ ID NO: 197924 - DNA, 1854 bp, Homo sapiens
  Payload ID: 19038
  Gene Name: UDP glucuronosyltransferase 2 family, polypeptide B28
  ENST ID: ENST00000612433
  CDS Start-End: 15-1604
tgcattgcaccaggatggctctgaagtggacttcagttcttctgctgatacatctcggttgttactttagctctgggagttgtggaaaggtgctggtgtggaccggtgaatacagccattggatgaatatgaagacaatcctgaaagagcttgttcagagaggtcatgaggtgactgtactggcatcttcagcttccattctttttgatcccaatgacgcattcactcttaaactcgaagtttatcctacatctttaactaaaactgaatttgagaatatcatcatgcaacaggttaagagatggtcagacattcaaaaagatagcttttggttatatttttcacaagaacaagaaatcctgtgggaatttcatgacatatttagaaacttctgtaaagatgtagtttcaaataagaaagttatgaaaaaactacaagagtcaagatttgacatcatttttgcagatgctttttttccttgtggtgagctgctggctgcgctacttaacataccgtttgtgtacagtctctgcttcactcctggctacacaattgaaaggcacagtggaggactgattttccctccttcctacatacctgttgttatgtcaaaattaagtgatcaaatgactttcatggagagggtaaaaaacatgatctatgtgctttattttgacttttggttccaaatgtgtgatatgaagaagtgggatcagttttacagtgaagttttaggaagacccactaccttatttgagacaatggggaaagctgacatatggcttatgcgaaactcctggagttttcaatttcctcatccattcttaccaaacattgattttgttggaggactccactgcaaacctgccaaacccctacctaaggaaatggaggaatttgtacagagctctggtgaaaatggtgttgtggtgttttctctggggtcagtgataagtaacatgacagcagaaagggccaacgtaattgcaacagcccttgccaagatcccacaaaaggttctgtggagatttgatgggaataaaccagatgccttaggtctcaatactcggctgtataagtggataccccagaatgaccttctaggtcatccaaaaaccagagcttttataactcatggtggagccaatggcatctatgaggcaatctaccatgggatccctatattgggcattccattgtttgccgatcaacctgataatattgctcacatgaaggccaagggagcagctgttagattggacttcaacacaatgtcgagtacagacttgttgaatgcactgaagacagtaattaatgttcctttatataaagagagtgttatgaaattatcaagaattcaacatgatcaaccagtgaagcccctggatcgagcagtcttctggattgaatttgtcatgcgccacaaaggagccaaacaccttcgagttgcagcccgtgacctcacctggttccagtaccactctttggatgtgattgggtttctgctggcctgtgtggcaactgtgacatttatcatcacaaagtgttgtctgttttgtttctggaagtttactagaaaagtgaagaaggaaaaaagggattagttatgtccgacatttgaagctggaaaacctgatagatgggatgacttcagtttattccagcaagaaagattgtgatgaaagatttctttcttcctatgacaaaaaaaaaaatacaaaaaaaaatctttttgaaatctaccttgtcaagtgaaaatttgtttttcagagatttaccacccaagtaatggttagaaatattttgtggcaatgaggaaaacactagggaaaataaaaaataatataaagccat

SEQ ID NO: 197925 - DNA, 2103 bp, Homo sapiens
  Payload ID: 19039
  Gene Name: UDP glucuronosyltransferase 2 family, polypeptide B4
  Uniprot ID: P06133
  ENST ID: ENST00000305107
  CDS Start-End: 48-1634
gacagaaaggagcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactgtattggcatcttcagcttccatttctttcgatcccaacagcccatctactcttaaatttgaagtttatcctgtatctttaactaaaactgagtttgaggatattatcaagcagctggttaagagatgggcagaacttccaaaagacacattttggtcatatttttcacaagtacaagaaatcatgtggacatttaatgacatacttagaaagttctgtaaggatatagtttcaaataagaaacttatgaagaaactacaggagtcaagatttgatgttgttcttgcagatgctgttttcccctttggtgagctgctggccgagttacttaaaataccctttgtctacagcctccgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggaaatggaagagtttgtccagagctctggagaaaatggtgttgtggtgttttctctggggtcgatggtcagtaacacgtcagaagaaagggccaatgtaattgcatcagcccttgccaagatcccacaaaaggttctgtggagatttgatgggaataaaccagatactttaggactcaatactcggctgtacaagtggataccccagaatgatcttcttggtcacccaaaaaccagagcttttataactcatggtggagccaatggcatctatgaggcaatctaccatggaatccctatggtgggcgttccattgtttgcagatcaacctgataacattgcacacatgaaggccaagggagcagctgttagtttggacttccacacaatgtcgagtacagacttactcaatgcactgaagacagtaattaatgatcctttatataaagagaatgctatgaaattatcaagaattcatcatgatcaaccagtgaagccccttgatcgagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgta

SEQ ID NO: 197926 - DNA, 596 bp, Homo sapiens
  Payload ID: 19039
  Gene Name: UDP glucuronosyltransferase 2 family, polypeptide B4
  ENST ID: ENST00000510114
  CDS Start-End: 434-596
attctcctgcctcagactccggagtagctgggactacaggcgccggccaccaagcctggctaattttttgtatttttagtagagatggggtttcaccgtgttagccaggatggtctggatctcctgacctcttgatccacccgccttggcctcccaaagtgctgggattaacggtgtgagccacctcgcccagcctggagccctttctttaatataaacataaatgttagtcaacttgtttaaatataaacatgtgagctgcttgagcacagggactacatcataatgttttttgctctcttacatgtctcatcaacgaatggattagtgtaaaagttacattttaacttcttgactgatttatactggatgtcaccatgagaaatgacagaaaggagcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactg

SEQ ID NO: 197927 - DNA, 1836 bp, Homo sapiens
  Payload ID: 19039
  Gene Name: UDP glucuronosyltransferase 2 family, polypeptide B4
  Uniprot ID: P06133
  ENST ID: ENST00000512583
  CDS Start-End: 1-1110
atgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactgtattggcatcttcagcttccatttctttcgatcccaacagcccatctactcttaaatttgaagtttatcctgtatctttaactaaaactgagtttgaggatattatcaagcagctggttaagagatgggcagaacttccaaaagacacattttggtcatatttttcacaagtacaagaaatcatgtggacatttaatgacatacttagaaagttctgtaaggatatagtttcaaataagaaacttatgaagaaactacaggagtcaagatttgatgttgttcttgcagatgctgttttcccctttggtgagctgctggccgagttacttaaaataccctttgtctacagcctccgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggaaatggaagagtttgtccagagctctggagaaaatggtgttgtggtgttttctctggggtcgatggtcagtaacacgtcagaagaaagggccaatgtaattgcatcagcccttgccaagatcccacaaaaggttctgtggagatttgatgggaataaaccagatactttaggactcaatactcggctgtacaagtggataccccagaatgatcttcttgatataaagagaatgctatgaaattatcaagaattcatcatgatcaaccagtgaagccccttgatcgagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgta

SEQ ID NO: 197928 - DNA, 1887 bp, Homo sapiens
  Payload ID: 19040
  Gene Name: UDP glucuronosyltransferase 2 family, polypeptide B7
  Uniprot ID: P16662
  ENST ID: ENST00000305231
  CDS Start-End: 47-1636
acagaaaggaacagcaactggaaaacaagcattgcattgcaccaggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaactaaaactgagttggagaatttcatcatgcaacagattaagagatggtcagaccttccaaaagatacattttggttatatttttcacaagtacaggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctctacaagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagcctta

SEQ ID NO: 197929 - DNA, 866 bp, Homo sapiens
  Payload ID: 19040
  Gene Name: UDP glucuronosyltransferase 2 family, polypeptide B7
  ENST ID: ENST00000502942
  CDS Start-End: 399-866
aacgtgactgacagacagctgaggcagccccttaggcaacttaagcctgccttgtggagtgcccctgtgggggactccagccagcctgagtgacatgatccaaagagccctcctgggtaggaaattgccccggtggaatccctcaccagagaagcaggtagcaggccctcgcagaggattaacacagtggctgaacaccaggaaggaactggcacttggagtccagacatctaaaatttggaaatgaaagcatttgtccagatctctggcaaagatggcactgtggtgttttctctggggccagttgtgcaaaaccttatagaagagaaggctgatctcattgcttcagacttggcccagattccacagaaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctctacaagtggataccccagaatgaccttctaggtcatccaaagaccagagcttttataactcatggtggagccaatggcatctacgaggcaatctaccatgggatccctatggtggggattccattgtttgccgatcaacctgataacattgctcac

SEQ ID NO: 197930 - DNA, 1633 bp, Homo sapiens
  Payload ID: 19040
  Gene Name: UDP glucuronosyltransferase 2 family, polypeptide B7
  ENST ID: ENST00000508661
  CDS Start-End: 28-1137
ggaaaacaagcattgcattgcaccaggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaactaaaactgagttggagaatttcatcatgcaacagattaagagatggtcagaccttccaaaagatacattttggttatatttttcacaagtacaggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctctacaagtggataccccagaatgaccttctagatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaa

SEQ ID NO: 197931 - DNA, 1532 bp, Homo sapiens
  Payload ID: 19040
  Gene Name: UDP glucuronosyltransferase 2 family, polypeptide B7
  ENST ID: ENST00000622664
  CDS Start-End: 3-1010
ggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaactaaaactgagttggagaatttcatcatgcaacagattaagagatggtcagaccttccaaaagatacattttggttatatttttcacaagtacaggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaagatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagcc

SEQ ID NO: 197932 - DNA, 5122 bp, Homo sapiens
  Payload ID: 19041
  Gene Name: UDP glycosyltransferase 3 family, polypeptide A1
  Uniprot ID: Q6NUS8
  ENST ID: ENST00000274278
  CDS Start-End: 359-1930
attaacgtgatttactgaggcccctgtcattcctggctcttagtaaggattttccagataggacagctgtgattacgcaggcagagaaaggttacagatcaggttaccaaccccctcctactgacttcaggtagtttgatagggtgagggcagattatcccatggagcatgcacccagggaggaggggcagcgggaaagagaacgaacagaagggcgagagaattggcaggatccgtctcctacctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactgggtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaagacttggacaacttcattgccaactttggggatgcagggtttgtccttgtggcctttggctccatgttgaacacccatcagtcccaggaagtcctcaagaagatgcacaatgcctttgcccacctccctcaaggagtgatatggacatgtcagagttctcattggcccagagatgttcatttggccacaaatgtgaaaattgtggactggcttcctcagagtgacctcctggctcaccccagcatccgtctttttgtcactcatggtgggcagaacagcgtaatggaggccatccgtcatggtgtgcccatggtgggattaccagtcaatggagaccagcatggaaacatggtccgagtagtagccaaaaattatggtgtctctatccggttgaatcaggtcacagccgacacactgacacttacaatgaaacaagtcatagaagacaagaggtacaagtcggcagtggtggcagccagtgtcatcctgcactctcagcccctgagccccgcacagcggctggtgggctggatcgaccacatcctccagactgggggagcgacgcacctcaagccctatgccttccagcagccttggcatgagcagtacctcattgatgtctttgtgtttctgctggggctcactctgggcactatgtggctttgtgggaagctgctgggtgtggtggccaggtggctgcgtggggccaggaaggtgaagaagacatgaggctaggtgtagccttgggtgaggggagggcatccctggtcctttgaaggttctccccaccccagcacacgccacccctctgttctctcttcagctccacctgccactgatcctgcaacttgcttctttctattctctgcctctgtttagaaatcttcacgcaccactgaggcttcttgacttgccccttgtgacttgaaaccccagctcagatacaaattttcacctgccagccctgcctcctcctttctcccttttcctagacacaggactctgacaacttcatcctccttgtttagatgacttcccagtttccagtccccatttctccttctatcacttttcataaaaaaactcaggaaatatttgacatatcttccatttcaaattcttccattttatgcagatatcttgcccttcctataagctctcctcaaagctcaggaaacctggtctgctctcctgcatttagggaaggagaacccctgccaagacctttgctcactgcctgagaccccttccttagagagcacctcctttgctggtcagacatggagcctgcagttggtcacagatgatactgctttatttcagtttttacagttgtcttcttaagattcccgtcttataaatggagtacagggaacctcaagtagtgaagtggaaatccatgtgtaaggctttgtggcttcaggtaccagtggctaaggtagttttaaagactttgttgattttagaaaaagtccatcttccatccccgacatggcagttaatacccttctatatggtaaaaccttagagattaccttaatctgctaggaacagaagcaagaaaaaccatggcgtaaacacccccagagtttttgttcatttgtttcatctttcttgataaagcccgaaggtagcccattcagggctgttgtggttggttgctccatcatgtcatcaatagcccatatcttttcttttttatcttccttagtgtaacaccaaactacctctctgatagctggtgttcatgaaatattttaccttcaaatgattgtacctttttatttgctttagagttctgaaataaaatgaaattccactgtaataaaactgtcaaatgcatggtgtctgatgagttaaaaacacagagtagaaaacaggcatatggagaggccctggatgaaccatagttttagattgtttaattctagaattgtgaaacagatcttgaaacaattcagatcaaaagatgaaactgttacaaatgctcctgcagaaatagagaatgccccccaccaaaaactttgccaattccatgaaaggatttgcttgcgagtctgcagagctgagtgctggatgtctatccattttgtgagttctcatgacacaagagccagaagcatgaagcacgcagaagtacattagagtgtgtgtatctgtgtgcgtataatacaaggttttattgctgtaattcttatgaaaccacatgaattgattgatggccatactcccatgaagggcagacatggatgcttccctgtgttttctgttgaatcaacagccatgatttcattcccctcatgagcaacataaggtcttagggataagcctccctggccagtaactcccccctcaccccagaacatagcctttctctaacacttggtaattcattgaggtcaactttatgccacttgtataaacttgcatccctaaaatctgatcataagcagccaatgagccagaatgatgcttctaatcttgctctgtccaagcaccctccacagggctgcaagcatggctctgacaacctagaaatctggtgttatccctcactgtttaaaatctttgttcccattgtgtggaatataagggctctatgatttggtcctggctaccaatctaggcacacctggagcagttctcctcccactcttttccaaatgttcgctacaccccctcagaacacattttgctgtttttaacctctgaggtttgtctatgcccttccttctctcagaaataccatcctattcttgctggaatgagaaacttctgcttatctgtcagtatccagtgtcattgtgttcacattggtaagcctgtgcctgaccactacacctgaaatggagctcactgcattctcttttgaagcatttttcttactatatcgcaattatttattacaatatctgtttcctatttagaaaccataaggtcataaagacagggactggttcctatttatcttgttatagaacctggcatagtgcctggaacaaatactgctaggacaactggataatattgagaaaaaaggcaatatttgatccagacttcacactatatcaaaaactgaattcctatacaccagatatctaggtacaaaaaatgataccatgctgagtctaagagaaaaagtgaatttttccatagcctgtgtatagggagagactttctaaataggaagaaaaaatcctgatacaacaagagaagtgtaaattaatttgacacaaaaaactttggcatggcaaaaatcatggtaagaagattagcgatccaaattaaaaagttggagaaacatagctgcagcatatatcttacacatagacctaatatttctgataaactaagaactattaaaattgaagaaagaacctatgatacatatacatactgaaataatattcagctttaaactacaataaacaaaagcagaataagctaatatggagcaaattccaatatggttaagtaaaaaatagcaaagagtaagagtaactataggatgtatccttttttttataagaaaaaggaaagtatgtgtatgggggataatgaaaaaaatacatatctatgtgcattgccttgcaaaaacagtgcagagggaataaaccagagtgtgatagattatctatgagggtggtgtttgaatagggtggaaggatccatgtgtttatgtttttacatagtttggattttggaaacgttaatattttgcataccaagtatatgtttaaataaacaaggagagaaaagccaagaactgaaatacaaacggaaacaaatgaaatcaattttttccaaatgaaaatgtaactatactgtagtgaaaaaaattagcatcattaccttttaaacacagtacttttactatatactgtatacaatcaatcaacagaaaaaaaaaagaactccaaa

SEQ ID NO: 197933 - DNA, 1114 bp, Homo sapiens
  Payload ID: 19041
  Gene Name: UDP glycosyltransferase 3 family, polypeptide A1
  Uniprot ID: Q6NUS8
  ENST ID: ENST00000333811
  CDS Start-End: 356-1114
agcatgcacccagggaggaggggcagcgggaaagagaacgaacagaagggcgagagaattggcaggatccgtctcctacctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactgggtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaaaatgggcaaccagctctcttcaccacccccagcttattctcctctggagtgtatcctgaaccactgagatggctttga

SEQ ID NO: 197934 - DNA, 1650 bp, Homo sapiens
  Payload ID: 19041
  Gene Name: UDP glycosyltransferase 3 family, polypeptide A1
  ENST ID: ENST00000507113
  CDS Start-End: 194-1402
agcatgcacccagggaggaggggcagcgggaaagagaacgaacagaagggcgagagaattggcaggatccgtctcctacctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactggatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaagacttggacaacttcattgccaactttggggatgcagggtttgtccttgtggcctttggctccatgttgaacacccatcagtcccaggaagtcctcaagaagatgcacaatgcctttgcccacctccctcaaggagtgatatggacatgtcagagttctcattggcccagagatgttcatttggccacaaatgtgaaaattgtggactggcttcctcagagtgacctcctggctcaccccagcatccgtctttttgtcactcatggtgggcagaacagcgtaatggaggccatccgtcatggtgtgcccatggtgggattaccagtcaatggagaccagcatggaaacatggtccgagtagtagccaaaaattatggtgtctctatccggttgaatcaggtcacagccgacacactgacacttacaatgaaacaagtcatagaagacaagaggtatgtggctctctaagcatgtggtcactaaggctgaatgaagatagaaaacacaagggatactgtgtatgtatttttcacaataatagctgaaacttctgtgacatggaataacatgtgtgtgatgctaacagcccacctgttttctctggtaagtctctaggaagactaatttaggttagatgctgagaattactttcctaccttaaggctgtgatggcgacaaattatatacacatgatctctttgactgatcttatattt

SEQ ID NO: 197935 - DNA, 1902 bp, Homo sapiens
  Payload ID: 19041
  Gene Name: UDP glycosyltransferase 3 family, polypeptide A1
  ENST ID: ENST00000503189
  CDS Start-End: 158-1468
aacgaacagaagggcgagagaattggcaggatccgtctcctacctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactgggtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaagacttggacaacttcattgccaactttggggatgcagggtttgtccttgtggcctttggctccatgttgaacacccatcagtcccaggaagtcctcaagaagatgcacaatgcctttgcccacctccctcaaggagtgatatggacatgtcagagttctcattggcccagagatgttcatttggccacaaatgtgaaaattgtggactggcttcctcagagtgacctcctggctcaccccagcatccgtctttttgtcactcatggtgggcagaacagcgtaatggaggccatccgtcatggtgtgcccatggtgggattaccagtcaatggagaccagcatggaaacatggtccgagtagtagccaaaaattatggtgtctctatccggttgaatcaggtcacagccgacacactgacacttacaatgaaacaagtcatagaagacaagaggtatgtggctctctaagcatgtggtcactaaggctgaatgaagatagaaaacacaagggatactgtgtatgtatttttcacaataatagctgaaacttctgtgacatggaataacatgtgtgtgatgctaacagcccacctgttttctctggtaagtctctaggaagactaatttaggttagatgctgagaattactttcctaccttaaggctgtgatggcgacaaattatatacacatgatctctttgactgatcttatatttgggagtccctctagtggaattccaactgaagcggggggtttctttgtgtgtttccccagtgtgcctgctcttctcacctctggcttcttcgtctgtgctgctccctagaacacccttcccttctcttcacaggactggctccttcatgacatttgggtctcttctccaatgtttcttccatagaca

SEQ ID NO: 197936 - DNA, 5002 bp, Homo sapiens
  Payload ID: 19041
  Gene Name: UDP glycosyltransferase 3 family, polypeptide A1
  ENST ID: ENST00000515801
  CDS Start-End: 366-539
agccttcattaacgtgatttactgaggcccctgtcattcctggctcttagtaaggattttccagataggacagctgtgattacgcaggcagagaaaggttacagatcaggttaccaaccccctcctactgacttcaggtagtttgatagggtgagggcagattatcccatggagcatgcacccagggaggaggggcagcgggaaagagaacgaacagaagggcgagagaattggcaggatccgtctcctacctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactgggtgagtgcttggccggagaattcccagacaggcgcgtcccggatccccgcactgccagggctccagcgaacggcgattgatcagagttatccaggcgattttccaggctgggcttgcggacctggctggaggagggagaagcccatctagccgtggggcagagaggggcctctattgctgaggtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaaaatgggcaaccagctctcttcaccacccccagcttattctcctctggagtgtatcctgaaccactgagatggctttgaccctcagaatctggaggaaaaacacctcctagcctgtgtatcctgaaccactgagtctgctttgaccctcagaatctggaggaaaaacacctcctagccctcggaacaaaggtttggccaaattatgaaggactggcttggtctcaggaaggaaccattcattgtgataccatctggcagctggacattttctgtaggcgtgaggacgaatggcctgaggccccacatgtgcaggctttttataccttgcagggaaatctagatctttgctgacagtgtaggattgatccagccctcctgctttgtcatttcaggagaggctgcaaagggcaattccagggaactaaagaaacaaatcccagaggcactcccagcagagaagccagctccctccagctctgctcctctgggtccacctcaacctctctatccagcttcagtctctcgcttgcctaatcctagaaatcctcaccctagacaagccccagtctcactcctcctcttccaacagatgccaggtgaatttggccccagtaaggtgcaggtctccttccccctacaggacttaaagtacattaagggggatttttggcaagttttcacatgaccctgacagatagatagaggctttccagaatttaacccaggtatttgaactctcttggagagacattgtgttacttttgaatcagatcctgatgaacactgagaagcaggctgctctgcaagtagcagagagatttggggatgagctttgtttcacatatagtgtcaggaaagggggcaaactttatccgactggaagagaagcagtaccagtaaatgaccctggatgggatggatcccagtgttgaaatgggagactggaagaggagatactttcaggacttggacaacttcattgccaactttggggatgcagggtttgtccttgtggcctttggctccatgttgaacacccatcagtcccaggaagtcctcaagaagatgcacaatgcctttgcccacctccctcaaggagtgatatggacatgtcagagttctcattggcccagagatgttcatttggccacaaatgtgaaaattgtggactggcttcctcagagtgacctcctggctcaccccagcatccgtctttttgtcactcatggtgggcagaacagcgtaatggaggccatccgtcatggtgtgcccatggtgggattaccagtcaatggagaccagcatggaaacatggtccgagtagtagccaaaaattatggtgtctctatccggttgaatcaggtcacagccgacacactgacacttacaatgaaacaagtcatagaagacaagaggtatgtggctctctaagcatgtggtcactaaggctgaatgaagatagaaaacacaagggatactgtgtatgtatttttcacaataatagctgaaacttctgtgacatggaataacatgtgtgtgatgctaacagcccacctgttttctctggtaagtctctaggaagactaatttaggttagatgctgagaattactttcctaccttaaggctgtgatggcgacaaattatatacacatgatctctttgactgatcttatatttgggagtccctctagtggaattccaactgaagcggggggtttctttgtgtgtttccccagtgtgcctgctcttctcacctctggcttcttcgtctgtgctgctccctagaacacccttcccttctcttcacaggactggctccttcatgacatttgggtctcttctccaatgtttcttccatagacagggttgtgtctttgacaatcctaactagcctcctctcccactcagcctaatcataatatactatttccttcctaacacttttcaagatttgtaatgactccatttatttatgtttttattaattgtctggcccccaacacaaaagagtagagagtcagcttcataagtacagcaatgtctctctctttttttcaactctgttcccagtgcttactgcagagcctgccacaaaataagtttccatgaatttcagttaagtgaggaaataaaagcggcatagtgaccttcttggttactgcccatccagccaatgatcttataatcaagaaggactgaataccttattatggtttcagaaacacaaaccctgaatcaggtacaagtcggcagtggtggcagccagtgtcatcctgcactctcagcccctgagccccgcacagcggctggtgggctggatcgaccacatcctccagactgggggagcgacgcacctcaagccctatgccttccagcagccttggcatgagcagtacctcattgatgtctttgtgtttctgctggggctcactctgggcactatgtggctttgtgggaagctgctgggtgtggtggccaggtggctgcgtggggccaggaaggtgaagaagacatgaggctaggtgtagccttgggtgaggggagggcatccctggtcctttgaaggttctccccaccccagcacacgccacccctctgttctctcttcagctccacctgccactgatcctgcaacttgcttctttctattctctgcctctgtttagaaatcttcacgcaccactgaggcttcttgacttgccccttgtgacttgaaaccccagctcagatacaaattttcacctgccagccctgcctcctcctttctcccttttcctagacacaggactctgacaacttcatcctccttgtttagatgacttcccagtttccagtccccatttctccttctatcacttttcataaaaaaactcaggaaatatttgacatatcttccatttcaaattcttccattttatgcagatatcttgcccttcctataagctctcctcaaagctcaggaaacctggtctgctctcctgcatttagggaaggagaacccctgccaagacctttgctcactgcctgagaccccttccttagagagcacctcctttgctggtcagacatggagcctgcagttggtcacagatgatactgctttatttcagtttttacagttgtcttcttaagattcccgtcttataaatggagtacagggaacctcaagtagtgaagtggaaatccatgtgtaaggctttgtggcttcaggtaccagtggctaaggtagttttaaagactttgttgattttagaaaaagtccatcttccatccccgacatggcagttaatacccttctatatggtaaaaccttagagattaccttaatctgctaggaacagaagcaagaaaaaccatggcgtaaacacccccagagtttttgttcatttgtttcatctttcttgataaagcccgaaggtagcccattcagggctgttgtggttggttgctccatcatgtcatcaatagcccatatcttttcttttttatcttccttagtgtaacaccaaactacctctctgatagctggtgttcatgaaatattttaccttcaaatgattgtacctttttatttgctttagagttctgaaataaaatgaaattccactgt

SEQ ID NO: 197937 - DNA, 3097 bp, Homo sapiens
  Payload ID: 19041
  Gene Name: UDP glycosyltransferase 3 family, polypeptide A1
  Uniprot ID: Q6NUS8
  ENST ID: ENST00000625798
  CDS Start-End: 221-979
agggggatacccaccatggtagaccagagccactggaaagaggcatgagtccacatatccataaaggcaaatatccaaatattggctgtctggacctacaggaatactaaagaaggcactgcagagacccacaactgagaaatactggctgtgtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaaaatgggcaaccagctctcttcaccacccccagcttattctcctctggagtgtatcctgaaccactgagatggctttgaccctcagaatctggaggaaaaacacctcctagcctgtgtatcctgaaccactgagtctgctttgaccctcagaatctggaggaaaaacacctcctagccctcggaacaaaggtttggccaaattatgaaggactggcttggtctcaggaaggaaccattcattgtgataccatctggcagctggacattttctgtaggcgtgaggacgaatggcctgaggccccacatgtgcaggctttttataccttgcagggaaatctagatctttgctgacagtgtaggattgatccagccctcctgctttgtcatttcaggagaggctgcaaagggcaattccagggaactaaagaaacaaatcccagaggcactcccagcagagaagccagctccctccagctctgctcctctgggtccacctcaacctctctatccagcttcagtctctcgcttgcctaatcctagaaatcctcaccctagacaagccccagtctcactcctcctcttccaacagatgccaggtgaatttggccccagtaaggtgcaggtctccttccccctacaggacttaaagtacattaagggggatttttggcaagttttcacatgaccctgacagatagatagaggctttccagaatttaacccaggtatttgaactctcttggagagacattgtgttacttttgaatcagatcctgatgaacactgagaagcaggctgctctgcaagtagcagagagatttggggatgagctttgtttcacatatagtgtcaggaaagggggcaaactttatccgactggaagagaagcagtaccagtaaatgaccctggatgggatggatcccagtgttgaaatgggagactggaagaggagatactttcaggtatgcatcatggagggattacgtaggactaagaccaagcctcttgattatagcaagctatctatgatagaccagggatttaatgaaaatcccactgccttcttggagaggctaagaggggccttggtaaagcatacccccgtatcttctgattcagtgaagggacaactaattctgaagaataaatttattactcagacagcccctgatatcaggaggaagttgcagaaatgggccctgggaccagataatactttagaggtctaactgaaagtggccatctttgccttttacaatagagatgggggacacaagaaagaggcagaagcattaatggtcaccatgcaagcccataaaccccagaattcccagggtacacttgttaattgctacagatgtggcaagaacagttgtctctcttctaaagttgaaccgcttctatacaaggtttaatttctttcaccagggtgaaacagctcaaagcagaatggttttagtattttcacttgttatttctgtgatctttggcactagattattttcttgtataatacacttgtttaacccatgcctacttaaccttataaaacttgttttttcctctcacttagaggccatcaaactccaaatggtcaggcaaccggagcctcggacaacggctcccttttgcaaggacccttagataaacctctgggaggaatctgactgctgttttctccaaaatagtgccacctgtcagcagaaattagctaagattggccatcgtccatattctaatggcagttagatttgcctctgcagagaggggagatgatacggctaggagacagagaaatactgggtagaagagggcagttccctggcaaaggtcccaatttcaagcctggaaacctctggccctaactgagaacatgcattcctgttttcacacacaaaagttgccttttggctctccacacgcccctctcctgtactcatataaatctgagacctcaggttccagaagcagatgaaaaggagatgaacagaagagcagaagaatggcataatggtgtggcagagagaagagaaggagagtctgaacaccaagaggagttcagctgggggcgattggagaggagatcagccactggatggctgaactccaggaagaccatcttcccattccgtctcctttccagctccccatgcatcccatccccaccactcaataaaacccccacattcaccatc

SEQ ID NO: 197938 - DNA, 2355 bp, Homo sapiens
  Payload ID: 19042
  Gene Name: UDP glycosyltransferase 3 family, polypeptide A2
  Uniprot ID: Q3SY77
  ENST ID: ENST00000282507
  CDS Start-End: 103-1674
cccacagccagtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtaggtggaagccattatctactgatggaccgggtttctcagattcttcaagatcacggtcataatgtcaccatgcttaaccacaaaagaggtccttttatgccagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttaaatagaaaggatatcatggattccttaaagaatgagaacttcgacatggtgatagttgaaacttttgactactgtcctttcctgattgctgagaagcttgggaagccatttgtggccattctttccacttcattcggctctttggaatttgggctaccaatccccttgtcttatgttccagtattccgttccttgctgactgatcacatggacttctggggccgagtgaagaattttctgatgttctttagtttctgcaggaggcaacagcacatgcagtctacatttgacaacaccatcaaggaacatttcacagaaggctctaggccagttttgtctcatcttctactgaaagcagagttgtggttcattaactctgactttgcctttgattttgctcgacctctgcttcccaacactgtttatgttggaggcttgatggaaaaacctattaaaccagtaccacaagacttggagaacttcattgccaagtttggggactctggttttgtccttgtgaccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaattctttccagtcctcttgtcctcctttgtttgccatcagcaagggctatgctgtgattctgtctctgagtgacttggaccactgaccctcagatttccagccttaaaatccaccttccttctcatgcgcctctccgaatcacaccctgactcttccagcctccatgtccagacctagtcagcctctctcactcctgcccctactatctatcatggaataacatccaagaaagacaccttgcatattctttcagtttctgttttgttctcccacatattctcttcaatgctcaggaagcctgccctgtgcttgagagttcagggccggacacaggctcacaggtctccacattgggtccctgtctctggtgcccacagtgagctccttcttggctgagcaggcttggagactgtaggtttccagatttcctgaaaaataaaagtttacagcgttatctctccccaacctcactaa

SEQ ID NO: 197939 - DNA, 572 bp, Homo sapiens
  Payload ID: 19042
  Gene Name: UDP glycosyltransferase 3 family, polypeptide A2
  ENST ID: ENST00000515131
  CDS Start-End: 158-572
acatcagctcaagattttaagcaagtctctcaggaaatagatcgcggggctggcagtatgagccagtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtaggtggaagccattatctactgatggaccgggtttctcagattcttcaagatcacggtcataatgtcaccatgcttaaccacaaaagaggtccttttatgccagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttaaatagaaaggatatcatggattccttaaagaatgagaact

SEQ ID NO: 197940 - DNA, 1476 bp, Homo sapiens
  Payload ID: 19042
  Gene Name: UDP glycosyltransferase 3 family, polypeptide A2
  ENST ID: ENST00000504685
  CDS Start-End: 94-456
agtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtaggtggaagccattatctactgatggaccgggtttctcagattcttcaagatcacggtcataatgtcaccatgcttaaccacaaaagaggtccttttatgccagattttaaaaaggaagaaaaatcatatcaagttatcagttggcttgcacctgaagatcatcaaagagaatttaaaaagagttttgatttctttctggaagaaactttaggtggcaggacttggagaacttcattgccaagtttggggactctggttttgtccttgtgaccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaattctttccagtcctcttgtcctcctttgtttgccatcagcaagggctatgctgtgattctgtctctgagtgacttggaccactgaccctcagatttccagccttaaaatccaccttccttctcatgcgcctctccg

SEQ ID NO: 197941 - DNA, 1924 bp, Homo sapiens
  Payload ID: 19042
  Gene Name: UDP glycosyltransferase 3 family, polypeptide A2
  Uniprot ID: Q3SY77
  ENST ID: ENST00000513300
  CDS Start-End: 94-1563
agtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttaaatagaaaggatatcatggattccttaaagaatgagaacttcgacatggtgatagttgaaacttttgactactgtcctttcctgattgctgagaagcttgggaagccatttgtggccattctttccacttcattcggctctttggaatttgggctaccaatccccttgtcttatgttccagtattccgttccttgctgactgatcacatggacttctggggccgagtgaagaattttctgatgttctttagtttctgcaggaggcaacagcacatgcagtctacatttgacaacaccatcaaggaacatttcacagaaggctctaggccagttttgtctcatcttctactgaaagcagagttgtggttcattaactctgactttgcctttgattttgctcgacctctgcttcccaacactgtttatgttggaggcttgatggaaaaacctattaaaccagtaccacaagacttggagaacttcattgccaagtttggggactctggttttgtccttgtgaccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaattctttccagtcctcttgtcctcctttgtttgccatcagcaagggctatgctgtgattctgtctctgagtgacttggaccactgaccctcagatttccagccttaaaatccaccttccttctcatgcgcctctccgaatcacaccctgactctt

SEQ ID NO: 197942 - DNA, 4084 bp, Homo sapiens
  Payload ID: 19043
  Gene Name: UDP glycosyltransferase 8
  Uniprot ID: Q16880
  ENST ID: ENST00000310836
  CDS Start-End: 523-2148
aagccaacctcgctcagcggacgactggccggatcccaacgcgctgccccttgcccagcctgcgagcgcgtggtacgaaggcgcgtctgcatccatgccccagcccggggagctggaggcgctcgcagtcagaggcgagtgatgctaggctgagcgcgtggcggcccgtgtcgtgccccgctgagccaagtgcggaagggcagcggcgcgctccgactctgctcgccgcacgcagggcggggcgcggctggggggcggggggcctggccgcccgctgggagctgcggacgagcaggcgcgctgaggacccgagggaggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcaaactcgcgcggggcagccaagagacgagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccagagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatatatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggtttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaagaaatggcacagttttttgtatttttttttttagttattttttgttgttgttgtttgtattgtttttcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcactagttggcaactatgaatttattccatgtcattctgtttacttagcacttgcactacccttgttggttgagtgtatgctttatttgtttctagtttgaaatcccacatctgatagctgagagtaggcaaatacaacatttacctaatgtcattcactaacatggaagagttgtgaaaattctagagtgctgtaaatccttggcatacactatgacaaacaacttcattactctcccaccaggagctgctctcctgcacttagaaataatgtcacaagtagttttctaatgtacaatgcagacaaatgtactgctctctgaatacttgaagaaatggtattatacatacatagaaacttattagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggcactgattggatgattaaacataagttaatctccactgtgataaaaacttaaataataaacatgatttaaaatag

SEQ ID NO: 197943 - DNA, 2448 bp, Homo sapiens
  Payload ID: 19043
  Gene Name: UDP glycosyltransferase 8
  Uniprot ID: Q16880
  ENST ID: ENST00000394511
  CDS Start-End: 515-2140
gggttggttccaagtctttgctattgtgaatagtgccgcaataaacatacgtgtgcatgtgtctttatagcagcatgatttatagtcctttgggtatatacccagtaatgggatggctgggttctagatccctgaggaatcgccacattgacttgcacaatggttgaactagtttacagtcccaccaacagtgtaaaagtgttcctatttctccacatcctctccggcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgattttttttttagacaaagtattagatcagatatttttggggaaaaatgctttgtgattgcttgttttgaatggtgagcattgtattttgttttaagttgttttctggttgttattacagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccagagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatatatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtccc

SEQ ID NO: 197944 - DNA, 735 bp, Homo sapiens
  Payload ID: 19043
  Gene Name: UDP glycosyltransferase 8
  ENST ID: ENST00000507710
  CDS Start-End: 311-735
aggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcaaactcgcgcggggcagccaagagacgagtgagagtaacacatgcgcactgtggattcctttgtgaatacataaaaggaaaagttaaaactcttataattcacactatccagagaaaaacaatactattttgctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatat

SEQ ID NO: 197945 - DNA, 2777 bp, Homo sapiens
  Payload ID: 19044
  Gene Name: UDP-Gal:betaGal beta 1,3-galactosyltransferase polypeptide 6
  Uniprot ID: Q96L58
  ENST ID: ENST00000379198
  CDS Start-End: 15-1004
ccggcgcgggcgccatgaagctgctgcggcgggcgtggcggcggcgggcggcgctaggcctgggcacgctggcgctgtgcggggcggcgctgctctacctggcgcgctgcgcggccgagcccggggaccccagggcgatgtcgggccgcagcccgcctccccccgcgcccgcgcgcgccgccgccttcctggcagtgctggtggccagcgcgccccgcgccgccgagcgccgcagcgtgatccgcagcacgtggcttgcgcggcgcggggccccgggcgacgtgtgggcgcgctttgccgtgggcacggccggcctgggcgccgaggagcggcgcgccctggagcgggagcaggcgcggcacggggacctgctgctgctgcccgcgctgcgcgacgcctacgaaaacctcacggccaaggtgctggccatgctggcctggctggacgagcacgtggccttcgagttcgtgctcaaggcggacgacgactccttcgcgcggctggacgcgctgctggccgagctgcgcgcccgcgagcccgcgcgccgccgccgcctctactggggcttcttctcgggccgcggccgcgtcaagccgggggggcgctggcgcgaggccgcctggcaactctgcgactactacctgccctacgcgctgggcggcggctacgtgctctcggccgacctggtgcactacctgcgcctcagccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaacgtggtttcacatcaatccgctttcatgggattttggtctctgtccagtgacttcgtggtaaatgtaactcagtgtttgcttgcgacttatttataaatattgtaagtttgtgtcgatgagtgtaagttggcagtgcgcacgtctcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccttgaaagcccctcgtttaatgagaaaagcgaacactgcggtccttgccaaagtaaaatgaagctgccccaggacaaggggttaccatgagctccctggagtccgacgcgggttttctctctgggggacctgggtggtccccgctgtggtctttgttgtcccactttgggaccgggtccagtctggggtctagtctcgagcatcagggtcaggctcggggcagggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctgacctacaaaaaaatggaaatttagtgtttttcagcctaagacattaaatttcatatcagaacaaa

SEQ ID NO: 197946 - DNA, 5094 bp, Homo sapiens
  Payload ID: 19045
  Gene Name: UDP-Gal:betaGlcNAc beta 1,3-galactosyltransferase, polypeptide 1
  Uniprot ID: Q9Y5Z6
  ENST ID: ENST00000392690
  CDS Start-End: 93-1073
tattagtaatatgctgcctttggaagatgaaaacaaactagtgccaaggaggcgtattcttcaatatttggaatagacgtgttctcaagacaatggcttcaaaggtctcctgtttgtatgttttgacagttgtgtgctgggccagcgctctctggtacttgagtataactcgccctacttcttcttacactggctccaaaccattcagccacctaacagttgccaggaaaaacttcacctttggcaacataagaactcgacctatcaacccacattcttttgaatttcttatcaacgagcccaataaatgtgagaaaaacattccttttcttgttatcctcatcagcaccactcacaaggaatttgatgcccgtcaggcaatcagagagacgtggggggatgagaacaactttaaggggatcaagatagccaccctgttcctcctgggcaagaatgctgatcctgttctcaatcagatggtggagcaagagagccaaatcttccatgatatcatcgtggaggactttattgactcctaccataaccttaccctcaaaacattaatggggatgagatgggtggccactttttgttcaaaagccaagtatgtcatgaaaacagacagcgacatttttgtaaacatggacaatcttatttataaattactgaaaccctccaccaagccacgaagaaggtattttactggctatgtcattaatggaggaccgattcgggatgtccgcagtaagtggtatatgcccagggatttgtacccagacagtaactacccacctttctgttcggggactggctacatcttttcagccgatgtagctgaactcatttacaagacctcactccacacaaggctgcttcaccttgaagacgtatatgtgggactgtgtcttcgaaagctgggcatacatcctttccagaacagtggcttcaatcactggaaaatggcctacagtttgtgtaggtatcgccgagttatcactgtgcatcagatctctccagaagaaatgcacagaatctggaatgacatgtcaagcaagaaacatctcagatgttaggatttttaccaatgtaaatatgtttcttttctttttttaagaaatgggacctaaggtgttggtattttccaggtgtcgggggaaatgaactggtgaaggggttttgtaaagtttttgcttcctgctataagttcttttcttggattaccaatttatgaatgttagactctggtcatagaaacaataaatgagttagaagggccagatttcattctcagtcccagagcattgctatttatctcaaaaagtgacttccaaacaactcttaggattgacgtaccgtgcatctgagataaaaatttggttctgggaaactgaaactcacagtaatgtgtcatatcatccctgcaaaaattaatacacaaatagaaaccattttcaaaagcaattcagaaaggatgcacagtcaggaagacacactggatgtgattattaatatcgtgtgtgttgttacattatatttttacatatattcccatgtaatgtgtacagtctttgcagttccaccaagaaatgaacttggtacctgcagagtggctgcagttaaatagatgggagtttaaatttgagaatcaaacattctatgtgtttggaagacaactctgcttgctcatccaaggattaaatctggtcagcaggtggaatgtgtataaaatgctacttaacaaagtaaacaaaagattttttttttctttttttttctttcttttttgttttgctctttcagaacaaacattaaatggtgcctccaaggaaactttgccaaatataatctcacctgcttccttccagacagtgtcgctaagtgcatttcacagtttttggatctggcaggcatatgtctctatgtagaaaataagttggttggaggccagagaacaataaatcacattgagaaaatacaaatttaagtatgcattataattaacataagcttagcaatagtataagatgcccccacacacagacatttgcaaagcacatgagaaaatctttaagggtgtcaatattattgaaagacttggccctacttgctaacatctgaaaacaccagagcatgttcagcagcaatgctgttatgaggtattctgggggctctgtgattgaggaaggatggggaaggccaggttcgggtcccgttgatgccaccatacttattgggccatatgagtaggcatcgtaatcttgtgcttcaatgtgttcatttataaaaatggctgtaaaaaacacctacctcacaggtgctgtgagagcaaattgcatttgctaagtattttgagatccttagcttaaaaggtgctacgtaatgcaatgtatcatgtattatgctaaatgctaaaataattgcataattacaatgatggtcatcagtagcagtaatatcatcttaatataaaatctgctgaaataaagatcagctgtgaactatcactgcacctaattctaccaaggcttgacttttccttggctgtaatttaggtgtttgggaaggcttccatttctctgagatttcttctggtttcaatgaataagtgactaggtcagtgtgttgccttgatatcccaaggtgctgaaagtagaggcagctgcctttctttgggaaggaacctctggttggggtatattacagtaaatgaagcatatactttgcaaaatgcatcacgacaacttagatctcaggaaccactgaatctgaattctctctaagaaatttgagcgcaggtaaagctagttcacctctttcagaagcagcagaataggcagtcagcaaacctgcacattgcacatcttctaccatttattagaaaacacctgtttgttctcaaagaaagccccacagctgaaagagtgtaccttttttatttatttacttttttttttttttttttttttttttttgagacggagtctagctctgtggcccaggcgggagtgcagtggcacaatctcggctcactgcaagctccgcctcccgggttcacgccattctcctgcctcagcctcccgagtagctgggactacaggcgcccgccatcacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggccctatttacttattttttaacctgacccctggagccccccgtaggagttgatagcaaacagatagacacaatgaataagtggaagtcatggcttgtttctgcaaaacacgatctctcatcccccacccgaaaggacctgatatgagacaagacttcccatcccttaacacatcttcatcttatggtcagcaggactgctggttttgattagacaatagcaattaggtaacctggggagagatggatcagcacaaggtgaaccaccctccaacctgcagcctcaactgctgtgagttccaatcactgggaaagtctcacgacttcttacttggtttaccttcgagttgtgcagctgaatcaagcctctgtctcatactattgccttgcatctaccccatgctcagtcaaaccacctctggtgtcaagaaattacacattataaacatcatatatgtacacctatgaatcgttttatatgtgtgtgcatacattatgatacagccctgatctttaaaaggagcaaaaatcagagaatcgtatgtcttaaagaactatttccttacttttttatgctaggtaatgcccatgtgacaaacatgtaaatattcatcaaagaccacatgtatatattttaaaggcattttttcttctccccaactgtatgtatagctagaatctgcttgctgtgtaaccttttcttctgcatggagcttttggtgaagcaaggccatttgtccagtgtttcatagccttaagcatgtttgcccttcgttttttgaatgttcaaaaaatgtttaagtgatcaagaaaaagctctaactttcgacttttgttaattttatgacatgacactggccaaaatattgtttcaattactgttgagccattcttatcatttccctgacataaaatatgcaatgttttagacagtattctaccaagagtctctcagacaatttttacaaaaactctttttttccattatgcactggataataacagtatcagtgtctatgttcttaaagttcctttttttaatttactttttggaaaaacgtttctctttggtggctagtttcggtggcttggtgtcttcttatattggaacaagtgtccatttcaatatgtaatattgtatttttaaataaccagaatcaacaaagcgaagatcacttttaatttggattcaattcagaagaataaaacccctttgcgtgacacgatatggggaaaataaactatttacagaggagccaaggaagaagtttttcgatcaaatctcttctatcaaaagacaatggaatatttacctaaagcatctgggattcattttttacctttcctaatatgtgggtttagtgggagaattgattatgtcatttcttctgtaaaggtgaaaatcgtttttataaacaacaaagtaacttgtgaatgaaagaagtaatttactagaacaacgcttgttgatgataattgacatttaggtataacgtcatatatgaatgattgtatttatgtatttatttgtcaaaattgtacatactgtttcgccaaaagtaattgtctgtaaaagtgcactctccaggtttgtagtactatttagggttacatgggttgccaatcaagctgctaatcagaatactatttttttgtatcaatgttataaaactaaaaatgacagacactgaagatatcattacactttcttcaccttcctcttgaaatgtaaactgttgactgaaagcgcaatgcttatgtacaggcccatctgtcatgaggaagattatggttccataaagctgatttttttaaaccattgggacaaataaacagaaggagaa

SEQ ID NO: 197947 - DNA, 3274 bp, Homo sapiens
  Payload ID: 19046
  Gene Name: UDP-Gal:betaGlcNAc beta 1,3-galactosyltransferase, polypeptide 2
  Uniprot ID: O43825
  ENST ID: ENST00000367434
  CDS Start-End: 757-2025
cgttaaattctgctctgtcagagagagcatctgtcaagcccacatttaaactgctgcctgcctgtgcagcagctgaggaaccgtggatttcatattatagactaaaaccccattaaaactgctcaaaatccttcctgcagctgccaggcaacaacgaaagaagagaggtaaatcctattcttttccaatacaactgaagcactacattttagctctggctgctttacattgcagctcagtgttattagtagaaatatggatactgagacgagaacacagcactgcattgtccagccaggaaaatagcagatgtaaaaagcttcaatgcatcaactgtcgggaagagtcaacagtgctacaagcagaacgggcaactacagctcttttgtttaacgaaagagagaaaatgaaagaaagggaaaatttcagaagactaggacccatatgaacaaggagggtaactcgaagacaagcagacagatggacactttggatactgtgaaaagcaatcgcaggaggcagactgttgggggatgtgcgcatgttcgatagcatcttttttgctgaagtgatggcgtgccaaaagtattttcagtgggcataatcctcttcacataaatggcctgaccaaggaagaatgactacaagagagacaatgtgactgaattagaaaatgattgccaaagaatagtattaaggagaagaaaacatttttggtcaccaatctctcatataccactactggatatttacaacatgcttcagtggaggagaagacactgctgctttgcaaagatgacctggaatgccaaaaggtctctgttccgcactcatcttattggagtactttctctagtgtttctttttgctatgtttttgtttttcaatcatcatgactggctgccaggcagagctggattcaaagaaaaccctgtgacatacactttccgaggatttcggtcaacaaaaagtgagacaaaccacagctcccttcggaacatttggaaagaaacagtccctcaaaccctgaggcctcaaacagcaactaactctaataacacagacctgtcaccacaaggagttacaggcctggagaatacacttagtgccaatggaagtatttacaatgaaaaaggtactggacatccaaattcttaccatttcaaatatattattaatgagcctgaaaaatgccaagagaaaagtccttttttaatactactaatagctgcagagcctggacaaatagaagctagaagagctattcggcaaacttggggcaatgaaagtctagcacctggtattcaaatcacaagaatatttttgttgggcttaagtattaagctaaatggctaccttcaacgtgcaatactggaagaaagcagacaatatcatgatataattcaacaggaatacttagatacgtactataatttgaccattaaaacactaatgggcatgaactgggttgcaacatactgtccacatattccatatgttatgaaaactgacagtgacatgtttgtcaacactgaatatttaatcaataagttactgaagccagatctgcctcccagacataactatttcactggttacctaatgcgaggatatgcacccaatcgaaacaaagatagcaagtggtacatgccaccagacctctacccaagtgagcgttatcctgtcttctgttctggaactggttatgttttttctggagatctggcagaaaagatttttaaagtttctttaggtatccgccgtttgcacttggaagatgtatatgtagggatctgtcttgccaagttgagaattgatcctgtaccccctcccaatgagtttgtgttcaatcactggcgagtctcttattcgagctgtaaatacagccacctaattacctctcatcagttccagcctagtgaactgataaaatactggaaccatttacaacaaaataagcacaatgcctgtgccaacgcagcaaaagaaaaggcaggcaggtatcgccaccgtaaactacattagaaaagacaattttttttcaaatgtgcaatttgtaaatattgctaaaagcatgtatagttagaactgattacatccgtaggacaagttttagttaaaactcatcacataaagaaattcaagaagtatttttttaatttctgaagaagttaattcttaaaactataacattatataacaaaaaaggtttcccaaaacaatctatttaaaaaactgtataaggagattctgtgtattaacatgcaataacaagcatgcataaatcaatggttcaagtcttctgttaggggccaataaaatgtatctgcatatgttttccacataaattttaattcaagaaatgacagtcaaaagatccttcattttagattaagcttttcattttaatatataatttaatgtaaataaaacatcactatcaattttaaggaaactttttaattgtgcaaaggataaattttttgacctattttagggttctaaatgcaataagatttagttgagttattccacaaacacattataaagttcagatgtttcatcaatgcagttctcacgaaagtatttactttttaaaaataactgagatattattttaaatttcttttattaatactttcttttattaatatatgggggaaaattattttgacatgacgtggtaaaatgtgaaaaactaatgtgtctcaggctcaagtttttatagttattaaatgtttcaaaatagacaagttttgtttcctcattgatgttaagaaccaaactcctatttcaatgagttattggattagaccaattactgcactcttaaacagcaccaccatttaatttcatgtatatctaacttcgaatatatctgtaaagataatcgaagcaaaagtaatcacttaaaggcacaaataggatgtactgttgaaaaagataaagagtgcaggtgcagtttcattcaacacatttttaagatgcatgtctgccaaaatgcaacatacgggaagtttatttcctgacagcaggtgtacacatgccaacacttaatcattttatggcacctatttctttcttggagtgccaagtttgcaaacctgcagtttttaatttggtagatgacaaatattctgaatcaccaattaaaaacctttttgggagggatggggaaaactacaaacgtttgacaaacacaattctaggatgaacaatgtatacaatgcacttttatgaagtttttaaaaataaaggaaaacaaaaaacttta

SEQ ID NO: 197948 - DNA, 1694 bp, Homo sapiens
  Payload ID: 19047
  Gene Name: UDP-Gal:betaGlcNAc beta 1,3-galactosyltransferase, polypeptide 4
  Uniprot ID: O96024
  ENST ID: ENST00000383209
  CDS Start-End: 289-1425
gccggggcgaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagaaaaaaagaaaaaaatgctgcagttgttctctcaagctagggcagaagaggggtgtcaagctcctcaataaacttgtctccacttc

SEQ ID NO: 197949 - DNA, 1694 bp, Homo sapiens
  Payload ID: 19047
  Gene Name: UDP-Gal:betaGlcNAc beta 1,3-galactosyltransferase, polypeptide 4
  Uniprot ID: O96024
  ENST ID: ENST00000451237
  CDS Start-End: 289-1425
gccggggcgaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagagaaaaagaaaaaaatgctgcagttgttctctcaagctagggcagaagaggggtgtcaagctcctcaataaacttgtctccacttc

SEQ ID NO: 197950 - DNA, 1694 bp, Homo sapiens; identical to SEQ ID NO: 197949
  Payload ID: 19047
  Gene Name: UDP-Gal:betaGlcNAc beta 1,3-galactosyltransferase, polypeptide 4
  Uniprot ID: O96024
  ENST ID: ENST00000415322
  CDS Start-End: 289-1425

SEQ ID NO: 197951 - DNA, 1694 bp, Homo sapiens; identical to SEQ ID NO: 197949
  Payload ID: 19047
  Gene Name: UDP-Gal:betaGlcNAc beta 1,3-galactosyltransferase, polypeptide 4
  Uniprot ID: O96024
  ENST ID: ENST00000419471
  CDS Start-End: 289-1425

SEQ ID NO: 197952 - DNA, 1694 bp, Homo sapiens; identical to SEQ ID NO: 197949
  Payload ID: 19047
  Gene Name: UDP-Gal:betaGlcNAc beta 1,3-galactosyltransferase, polypeptide 4
  Uniprot ID: O96024
  ENST ID: ENST00000430971
  CDS Start-End: 289-1425

SEQ ID NO: 197953 - DNA, 2606 bp, Homo sapiens
  Payload ID: 19048
  Gene Name: UDP-Gal:betaGlcNAc beta 1,3-galactosyltransferase, polypeptide 5
  Uniprot ID: Q9Y2C3
  ENST ID: ENST00000343118
  CDS Start-End: 278-1210
ctctctagagaaccctgactaatacacctggagtgcagaatctgctggagaaactgccattccgttattgactggctggtcaggccatacagcctggtggtctagatgtgtttggagtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctt

SEQ ID NO: 197954 - DNA, 2763 bp, Homo sapiens
  Payload ID: 19048
  Gene Name: UDP-Gal:betaGlcNAc beta 1,3-galactosyltransferase, polypeptide 5
  Uniprot ID: Q9Y2C3
  ENST ID: ENST00000380618
  CDS Start-End: 434-1366
gggcccagatagaacaagaaggcagaagaaatgtgaattcctctttctctgctggagctgggatattcttcttctcctgcccttggacatcagagctgcaggctctctggcctttggacccgaggatttataccaagcaggtttctgggttctcaggcctttggccttggactgatagttacaccattggcatatctggttctgaggctcttggtcttggactgagccacactcctggcatcccagcgtctccagcttgcatggcctgtcacgtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctta

SEQ ID NO: 197955 - DNA, 13170 bp, Homo sapiens
  Payload ID: 19048
  Gene Name: UDP-Gal:betaGlcNAc beta 1,3-galactosyltransferase, polypeptide 5
  Uniprot ID: Q9Y2C3
  ENST ID: ENST00000380620
  CDS Start-End: 593-1525
acaggaaagccgctggttgtgatggtggctatgacaaaccttcagcctgaagacccgggagggaaaaatgaagctgacaagaagcacgttgctgagtgatcctgggttcccatcctccgcacccgtgcatccacgcgtgggcccagccagcaaggagaagtctaacaggcaggaggaggggagacacaaggagcccccgcatttcatctggaagagaggccattgaaaccaagcatttgtgttcaagtaagaaaatgtatccaagtcacaaagaaacataatttggcttttggagacatgagcagcttcatttctcatttgttcattcgaaagtctccactgggcttctgagtgccacatcctgtccagaatgatgaaagatacagaaaatggtgcctgctgaccttctggagttattggctagtaagaaagtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactcttacttgaactcaggaaaagttacttgctgcaaaatggttttgaccatgttcaattgcaaaagtacgtctgatatcctattttgcataccatttcttgtgtttggattaagctgcttctttgtagatgtgtttcctcatcctggctgctctgaacgcactgggtcatgttcagaaaagcctccttctcaggtggaaaaaatcagggactgagcttgtcttttgaagcccaaatttaagagccacgcctctcggttccataggatgggccgcctctcattctgaagatgactgtgctttgagggagaagtcgtctgtttggcagtaggcctgcgtctgtgtttcgtggtctaccttgtcaggtgtgtgtctgtgtggccactggtctcagtcggcgaggccggtccagctgctgcctctgtgtgactggctttgggtctggccttcacagcatcagctcacagcccacagctccagggacaaatgaggacaggcgtgggctctccctactgcttctgtgtgttcttaaaggattttctttgagacccattgtttcccctcccctcccctcccctcccatccccttccctcttcttttcttttctttttttctgacagggtctcaccctgtcacccaagctggagcgtagtggcctgatctcgctgcagccttgaactcaacgagcctcaaacgagcctcctgcctcagccagtgggtagttgggattacaggtgtgtatttctttatacaatgaataattctttttcttgaggaaaaaacattatttcatgaatctagaacttgaaggaaccttagagctcattcaatcctgcctcctcttttatgtgggatgcaaacgaggctcagagagacgtaacaacttgcccaggaccttcccagcttgtttgttgcagaaggagggttccagctcagcgtgggtttcctggtgctgtcttgtctggatgtgagagtgagaaacaatgtgaaagcatgagtgaggaggccaagcagtgcttccccaggaacacccagcgctagctccagagtgggaatggagaggtccaggttggccgggccggggcttcaccgcaggcacccagagaggaaggattccgatgggcaggtgctgagctaggggctgtgtaggtattgcctcatctacatgctctcaatgagttttccgggggcagagacctgcagttgctcaggtttacagattaggaaactgaggcagagagagagagggtgaacaactcattcaaggttacataggtgaaaagtggtggaaacggggtgaccctaagctgccctgtggcctccccagccacctgctgacggagctgtgggagcacattgcattggctgctcccactgcctctctggggtgcctcctcagactcccccaaccatacacgcctacacccagcccccaaacctccgtactctgccttctactgtgactgtggcagaagccacttggcccccgtggtgccagaacccctggtattggactgactccagctcttcttccacagctcctgatgtggcctcactctcgtcctaccacctgctgtcccctctgctggatcaccccattagcacacagacacgctgccattttccacctgaccagaaatggccaccaccttccccgaccccttccctgacccccttccccgtcccgctgccccatcctgttgcgtttctggtggaaccccgcacgagagttttacttgtctgttgcctcgtcctaatccttcccttctttcccaaatgccgtctcatcagacttctgcacccccactccacccacatggcccttctcagggcacccaccaccccctgtggctgggtcctgtgggcagttcttgttctcctcctgcttgacgtggcgagtcctcatcaccagcttccaggacaccgggtgctcttggtctccctcctccttgctgctcgccttttccatctcccctgcttgctccttctctttgctctgacagtgtcgtgctggaggatcctgggctctgcgtggggccccctttcttccctggttatacccagtcctccgaggggcccaccttgtctcatggctttaaatatgttgatgatgtttccatttatctccagcctagaactctttcttgctcttcaatccactgcctacctgatttcccatagtgaacaatccaacactgaccttctggttaactgccccacatccagcccatctgcagccattcccgtctcaggtaatggccactccatcttcctgcagctcaagtgggaagccctggagccattccgactcctctcccatctggtgcatcaggaaagactgtgggaactaccttcaaattctctccaggagccaaccacctcctgcccctccactgcgaccacccttgttcaagcctgcattgcctctcacctgcattcgtgcagctacctccagaccctccctcagcttccattattgcatcctttggtctcttcccagcagcatccagagtgatcctttgaaaatctcatttctctgctcaaaaccctcctgaggtttcccatcaccaaggatattaaggataaaaaccacatccttcataccattgtctacctgtgattccctaatcgtgtccctttgctcactccctctggcctcttgctgttccctgaacagcagtctgttccagccacagcagcccctttgccctatgtgcccatccccgtcagccttggcactggctgtcctctctgctgggagtgccctttcttcagatgctctcatgcttcgcttctttgccttgttgacatttggtcaatgtcaccttctcagtgaggcctaccctgacctccctgtaggaaaatgcaactcacctcactcccatgccccgtaccttatattgttttccttgcacttaccaatttctaacaaagcatgtaatatctgtttattataacatatctatattttatggtttatgtttcacgcaacttgaatgtaacctttgtgtgggccgtgggtctttctctgtttccttcactgacgcaccttggattcttagcatggtcccagcacatagtagatgctcaataaacatttgttgagtggaactgaatgtattggtatggtaggtgggttttagaagggaatgggtgaaccaggactgaaaaaaaagaaatatttttcaaagtaagccaacactgtggtttcacttgagtcagtaagtaggaaatgggtgcgactctgtgacctgaaaacctagaaatgctccacagccatgctcttcaccccttttcttccaaaacggaaaacctcacacaatgcagggtggacagaatcacacggtgcagtctgtgcgcctgtcctccagcccgacacctggccagtcctgtctcatctacactgtcatgcaaactcttgtttttgtttgtttgtttttgagacagagtctcactctgtcacctaggctgaagtgcagtggtgcagtcttggatcactgcaacctccacctcctgggttcttgtgcctcagcctcccgagtagctaggattataggcatgcaccaccaaccagctaatttttgtattgttagtagagacggggtttcaccatgttggccaggctggtcttgagctcctgacctcaggtaatctacgtgcctcagcctcccagagtgctgggattataggtgtgagccaccacacccagccatgtttcaagaatttgtgcttcagctcagcacttagtggcagtgggaagaccagacctcctgacccttcagcctgctggcatccaccatgccttaaaaaacaaaacaaaaccctaaatgtatttaattcctgctcctcttcaaacacaccattgtaaccacataatacactgtgtgaaaagagaggaaagaaaaatccaagtcaacaataacttgccaggccttctttccttgagccccatatcccacgcccgctgtgctaacctctggcttgccgcccacacctgtctggattcatcccgactcgagccacctcctcctaactggtcccacgggcctgtccctgccactttccaatctgtcctccacttgacatttggagtaattttttaaaacagcaaatctgattaggaaactcagaggcccagggaagccagtgacttgccctctggcaccctgtcctgagggtagagcttcctggcacagggtcagtgagccccgaggccacctccctggaggctgcaggagggtgagcgtggtcaagagcagcaattttcattgtttcatgtgtcattgcctatttaacgagcttcgcagtgccctcaatttgctaagttaactttggccacgccgtccgtgagaggtcagactggtgatttccaactcccgccgggcaccgggtgctgcaccggttatcccaacaggctggcacagagggctgaaatggacttggaaagccaaataattaattttcatgcgagtttttgatccccttgagtgtggttatttttgtgcaaaaaattatcccgatgtttactttggtttcataagtaatttattaaaattccttcctaagctttaaatttcagctaacaaatatgagcatggcctctgggaatggtaagaacaaggaagcattgtgtgtgtgtgtgcacaccccaaggttgtgcagctagaagtgcagaatgtggattccgtccgctctttagggcacagctagccctgtgcacctgtagaaactgtactgacgtacagccttgcagagcctccagcttccatggtggcaggagccatggaaaatagagacccacccggtaaggaggtaactgggacaccaggttactgtctacctggtggggaagctggggaaaagggcccatgggaggatactaactggggaagaggagaccttgcttccagggctgggcgacccacttacggaggccccattccatttacatctccgctcaagcctccgcctccgggttccagccctggctctgcaatttgctagctgtggccccaggtggtcattctctctgcacctcagtctctgcatctctataaaatgggatgataatagtgttcacctcagaaggttgtcagaggtgtggaaattaagataattcacattgagttcttggcacggctgtgcctagcactgggtgcaggctgaatgcatgggctgctatcgcgatgttgtatctaatggcctgcagtggttgcttagcagcaatgggtttgcttggttatttcctgatttggggtaaatagatccagagaccaaggctccatgttatccccagcaccgggctgaccccaagtaccagagaggtctccatggccccaggctgcagaggacccaggttacaacttgctcaagtagacccaggatctaggcttatcctagtagatcttggtaccaggccagcctctgtgacctgagactccaagaccaccattgcagacccaggctctaagctagcctctgcaaactcaggatatatattccaaatatccctgatttggggggcaaggtctgtgtgtgatttgcagagtaacgatatgaagaaggaggtcttgttaagatggcgtggtgtggagtgcccaggtgtgaaatggttgtctcaatggaagttgtagcctcctcctcccatgacatcatcctcacacgtgctcagtgttaggcattttttccccctcctgctctgaatcaatgcgagtgagatatgcatgcgggagggacaagcttgcatggcacccagctgtggtacatttagaactcggcctcagccctccagtgtgaccttgggcatacccttcacccccgggctctgttcgctggggcagggtctgcgctctggagtcaggctgcctgggtttgaattttaccttcctcgccaagtcccttgagtggcaagttacttatcttctcattgtctccgttttgttatctgaagaatgggaccatagtagttcccgcctcatgggatgatcatgtgggttaaatgagaggatgagtataaactgctcaacatcccatggtaggtgctcagtaaatgcaggtgcttatgattatagtcagtgtttgggctgtgaattttggtggattctatggtggtgtatacagcactatctatcagtgtacctgtcagtgtctggtgatctctgtgcaaatcaaaaactcttcagattgagtctgtagggctttgtttcagctcttgttctttttcttcatttgaatctttcctggaactcttggagaagttcttctgttcgtgacattcttcacaatcagagcactgtgttcttgaccctcttaattcagaatatgtgaaaatctgaatgaggtaaaagaagttggagctggaagatgccttagaaattatctacagtatttttttttttaagataaaaccttttacagttaggaaagccaaagctcagaaaaatggagtgactttgccaggtccttcagcgagtggcacatccaggattaaaagctggcatcagaaatcccatgtcagacattcattcgtttatttattcatctgttgagtgctcagtgctttgaccgggcatcctgaatgagggtcaagctgaggttcgaggccgtgggttttgcatacagagctttcactgggtaaatacacaatgctgagaagattatcaggggcacctgatcccttgacagctgaataaagaagcgttccagtgccttctctgtgggcatcgtaagccatgtccatccatacctgctgtttcactgaaaccccacagcagcctctggagggcaccattcttataattatgcccctggatttaagaggaggaaactgaggggcaggtgactcagtgacttccccgggggctcagacgtggtggagacacaggccctcggcctccaaatgctgcctcccgcgagcagccttgcttttctccacttggcacagtggtgagtcctccgatgtatctgctttcataggaagcttgggaccagccctgcccaaggagtgtgccacctgaccccttttcctgtcttctgtcacttttttttttccaagtgttgatatgagtttcagtctgccccttcctgggcctgtttgacctcctgggattcggcacttagttatctgtgtcattcccaaggacctcccgtttagctggatcccctgacctgtcctgccctggccagccctctcttgaggttactcaagtgtccaatggcagcccaaacaaatgtctggcttcagaaaataaactcttcagtccagcccactttccctgtctccctatctaatgcccttgcaaaacaagcccgggggcgccacactcagactgtgtgtgtgtgtgtgtgtgtgtgtatctatgagagagagagagacagacagacagatctgaggctctaattagagataccatgctcagtggaagctggttctgaacaatgttaactgccccacccgtgtccatgaagggcagtggaagagcaaggggcggtttaattacctgggatgtaaaacagcaggcacccccactgccctcctcagctgttggggtggcagggtggagttgagggcctcactcgttttcacctttgcacaatcagtcacacatttgttatatgacagctatgtgccacacacccatgttcagtaaggtggaagccagctgcaggcgtggtccacagttccagacatctctgaaggatgtgacaccaactttcaggcagaacatttagaaagagtgaaataaagtgaaacagatcaaccagcctattgagtatctacgtgttttttttacaggcaagaactgaggaggcaatactatttagaatccttgataaacagttccaaaagaaaaaaaaaaacaggctttggtgactctcatgggccctccgtgccaagagtctatggctctgtgatatattaaatcaggcttgttaattatttaatctaacagctgccatgcaccctcattttaaaaacagatgaggcaatgtttacattttctccatgtcctccatttggaagtgtcttagtttgttttgtgttgctgtaacagaataccacagactgggcgatttatagacaatagaaattaatctggctcatggttctagaggctaggaagtccaagagcttggcactggcctctggtgagggccttcatgctgtgtcattgtgggcaaaagagcaaaacttgctttgataaaatcactcttggcaataactgaccctcctcttataataacattaattcattcatgacagcagaaccctcctgacccagtcacctcttaaaaggtcccacctctcaacgctgttgcactggggattaagtttccttacacatgcactttgggggacacattcaaactgtagcaggaattatttgctttctcataacatttttttaattaattaattttcagcgtttgttatatcagaatggacattatagcaatttccatggctgtgtcgctcctggcagattttaaagttcttccagcctgattcctctctctgtttgggtctctggcatggtgcctgctggagagtagatacttgataattatctattgggttctcaggggatctctcaaaggtggtattcaggcacccacaaggcaactcccatcacaagaaagaatggtggcctgggagtgagctgtaaggttccttcaaacatcagttcctgaagcctcttttattcattattgttgggacttgtttttatttctgtttcgttctacgtgaccccaaaatctgtatgtgaacactaggaactttatcatgggctgaggtgtatttgaagtaaactcttaactatgtctctgggatatgaaaggtgcttacattctctgttgggaatgtagagagaaggatttgcagtgtgtggcccctgggaatgtagaggcatgaatttctgtctgttttcctgctgttgaaatctgagtgctaggaacggacctcttgctctcagattggccttgaagctgaagggaacctgtccaccctctgcacagggcaagagccacgccaacaggaggaagttggagtgcatcctggcacctgccaatcggaagactgacaaacaaaaaattagtttttaattaatttaaaaaatgatcttcctacttatcagacacaatcacttttaaatatgagcagaaaaacgaactccatagccaaatgcaacattttgtgtcatactgctttacatcatctattctacctccattcactggtcaaagaagcgcagagttaagttggccagtgtggcgtggacacagccaggcgcagaccctcctgccagcgaagccagcgtgaggtctgttggctcaggggtccagtccctgggtccccgaagaggtaagccaaagacatagtgatacttggttcaattcggctccagagagtatcagatgggaaatagatgacttgttttacctggtcaaataagacatcactaaaatctaccatgactggaaattacttaatgcaaccagaggagacttcgcagtcaaattttgcttttcctaaaagacacgaaattaaatttacatgtcactgaatgctatttgaaactgtcatttccttgtatattagggggatctgctagactcttatgtcattgtattttggaaatgggtatatgtccttattattggttaataatcatatttatttttaatgaaaattaaattatgaaaataatgcacttaactaggtgagttttaggttgtcgattgatgtgataattcactcttcccgaaaaattggcaaggtaatggtctgaatcggacaatccttttgtttttacattgatgttttctatatttattttgtacctggaaaaatatttttacaatttattttgattttatatgtgtagaaaaatgtactgaacaatgttgacatgcttatttttgtaagagatgggtacttcttgttccccttggatttcggaagcaaagcaatgggaccctacgcttcagagtcttaatggggtggggcagtgtccattgaggtgtcctgtcgggaatgacaagtccagggcagattatgaggcaggcatcctttggagttcttctctcaggtatattttaactaaaagctatcatttaagttgaagaaatcaagtcttgtgaattgatacgattgtacttctagagtctttgatgataagttgtctttgcggtacagattggctcctcgatctttcaaagtgtcatttaaatggaaataaatgtctgaaacaga

SEQ ID NO: 197956 - DNA, 2341 bp, Homo sapiens
  Payload ID: 19048
  Gene Name: UDP-Gal:betaGlcNAc beta 1,3-galactosyltransferase, polypeptide 5
  ENST ID: ENST00000398714
  CDS Start-End: 1-945
atgtgtttggagatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctt

SEQ ID NO: 197957 - DNA, 2617 bp, Homo sapiens
  Payload ID: 19048
  Gene Name: UDP-Gal:betaGlcNAc beta 1,3-galactosyltransferase, polypeptide 5
  Uniprot ID: Q9Y2C3
  ENST ID: ENST00000615480
  CDS Start-End: 289-1221
atcctcggcctggacccagcgcctccggggaccggccgcgcgccccctgcgtccgcgggccgggatgcggctctgagccagcggcggcttccagcccgactgggcctgccggggctgccccgcgcacgtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctt

SEQ ID NO: 197958 - DNA, 4201 bp, Homo sapiens
  Payload ID: 19049
  Gene Name: UDP-Gal:betaGlcNAc beta 1,4- galactosyltransferase, polypeptide 1
  Uniprot ID: P15291
  ENST ID: ENST00000379731
  CDS Start-End: 188-1384
gcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcaccccagagtcagaactgtacacatcccaaaatttggtggccgtggaacacattcccggtgatagaattgctaaattgtcgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaactgca

SEQ ID NO: 197959 - DNA, 1535 bp, Homo sapiens
  Payload ID: 19049
  Gene Name: UDP-Gal:betaGlcNAc beta 1,4- galactosyltransferase, polypeptide 1
  ENST ID: ENST00000535206
  CDS Start-End: 188-865
gcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccagtatgaaaaaataagaagactcctgtggtgaaggcttcgcctggtctgttctgctctggaggtggcagcgcatggtggttagtcccagcatcttcctggagatttgagcgtgagacgtgctggctgtgtgggctgtgccacctgaggaggattggccagtcataaggactcagcctggttgctgaatccagctggggaccttgaccccagtgactggcttttcagcggctacctgttctcgagacaaatgctgtcctcccctaaggagtctgggctgtggcaaagctatgacataggtacaaccgtccttttgccaggtggggcttaggtggagaagttgaagcctggactcagtcaagatctcaggactgggagcaaggagcctcttactcccagggtgcccacttggttcccactgactgttggtggaaactaggggctgagctggaggctttttagaggaagaaatgacaagctgggggctggattatccctgggggtgaaaatggagtcagctagataggttatgtcttgaaggagaggagggtcccctggtgtcaggaagcagagcctgaactccatgttagaccctggattggagagtgggcaggacacttgggagagacaggacttggtactggcgagggtactaccacacccattctgggagtggactatagagaaataaatcctaaaagtgg

SEQ ID NO: 197960 - DNA, 2004 bp, Homo sapiens
  Payload ID: 19050
  Gene Name: UDP-Gal:betaGlcNAc beta 1,4- galactosyltransferase, polypeptide 2
  Uniprot ID: O60909
  ENST ID: ENST00000309519
  CDS Start-End: 77-1282
agaacccctgcgccggagggagggtgggaatgtctgcacgtgggtctgggtgtgagctgtctgagagtctggatgtatggctgtggaagtccaggagcagtggccttgtttgccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagc

SEQ ID NO: 197961 - DNA, 2629 bp, Homo sapiens
  Payload ID: 19050
  Gene Name: UDP-Gal:betaGlcNAc beta 1,4- galactosyltransferase, polypeptide 2
  Uniprot ID: O60909
  ENST ID: ENST00000356836
  CDS Start-End: 791-1909
gtgttcagcctgccagccccgcccaaacgcacccctcagcctggccgccagcctgacccagaacccctgcgccggagggagggtgggaatgtctgcacgtgggtctgggtgtgagctgtctgagagtctggatgtatggctgtggaagtccaggagcagtggccttgtttgtgagtgtgggacttagtgtgttactgtcacccgggtgtgtctgtgactgtagttctctgtgtgtctgagtgtgggtgaccagctgggaccagggtgtccctgtgattctgtgtgcctgtgagactcaccctgctccctgaagcactgccagaagtggctgccgctctcttggaaccacagctggagccatcgcccaggcaagacccccttcctgccatgcccagtgctgtgcccatctccaggcccaagcatcccgttccgggaatcagaaccagctgtgctgggcaggacccagagtcttggtcccagtcccaaggggctggctttgaggtcttaagtgaggggtgtcccctgccttgccccgtattttgacgttttgctccagtgggaagggattctgtaaacatccagtctgtatttgggccccccggatgctgagggcaacttcccagcctggtcccagttggcctggcctgcttgtcgctgggatctgaatgaccaaaccacttcccaccatggctcctggaaggactaaatgaagtcatgagtataaagtgctcctgcatggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatgga

SEQ ID NO: 197962 - DNA, 2203 bp, Homo sapiens
  Payload ID: 19050
  Gene Name: UDP-Gal:betaGlcNAc beta 1,4- galactosyltransferase, polypeptide 2
  Uniprot ID: O60909
  ENST ID: ENST00000372324
  CDS Start-End: 363-1481
ccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagc

SEQ ID NO: 197963 - DNA, 1923 bp, Homo sapiens
  Payload ID: 19050
  Gene Name: UDP-Gal:betaGlcNAc beta 1,4- galactosyltransferase, polypeptide 2
  Uniprot ID: O60909
  ENST ID: ENST00000434555
  CDS Start-End: 283-1203
gaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatgga

SEQ ID NO: 197964 - DNA, 1911 bp, Homo sapiens
  Payload ID: 19051
  Gene Name: UDP-Gal:betaGlcNAc beta 1,4- galactosyltransferase, polypeptide 3
  Uniprot ID: O60512
  ENST ID: ENST00000319769
  CDS Start-End: 224-1405
atggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 197965 - DNA, 1871 bp, Homo sapiens
  Payload ID: 19051
  Gene Name: UDP-Gal:betaGlcNAc beta 1,4- galactosyltransferase, polypeptide 3
  Uniprot ID: O60512
  ENST ID: ENST00000367998
  CDS Start-End: 186-1367
cccgcttccaagatggcggcagcgatgcctgcccggctgttggggtggcggtgacgacaggcagcaaaagaccagataatgcctcacatctctgtccccccgggaccccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcg

SEQ ID NO: 197966 - DNA, 2414 bp, Homo sapiens
  Payload ID: 19051
  Gene Name: UDP-Gal:betaGlcNAc beta 1,4- galactosyltransferase, polypeptide 3
  Uniprot ID: O60512
  ENST ID: ENST00000622395
  CDS Start-End: 728-1909
gcctgcgggatacaacgggaatacaaaaatgcgctagagcggtccgcaacgctgtagcctgcgtaaggaacaattgatactaagtggcactaggctgcagggggtgccactgacacactgggagagggctcagccaaccacaaggtgataacgaggtcagcggagcaccagaaaccggctcactagcctcctgatcagtctcggcccagaggaaaatgaagggcttgagcttctgcttttacaaatctgaggggcaggaaatgaaatcccactagcagtctgcgtagtggagttgaaccctagcacccgctccccagggggtcgcctacaacgcgttccaggtgggcaggctcaggcgctgctccctcacaagcccccggccacgcggtgtctgggaccgggtgcctagtcagcccgggtggctccgccccgaggccccgccccatgacgcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgc

SEQ ID NO: 197967 - DNA, 2385 bp, Homo sapiens
  Payload ID: 19052
  Gene Name: UDP-Gal:betaGlcNAc beta 1,4- galactosyltransferase, polypeptide 4
  Uniprot ID: O60513
  ENST ID: ENST00000359213
  CDS Start-End: 544-1578
aagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagcttatcttccttgccagattttaaaaactattatggaaaatctcaagcattcacaaaagtagagagaaagaaaggactctcagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 197968 - DNA, 2459 bp, Homo sapiens
  Payload ID: 19052
  Gene Name: UDP-Gal:betaGlcNAc beta 1,4- galactosyltransferase, polypeptide 4
  Uniprot ID: O60513
  ENST ID: ENST00000393765
  CDS Start-End: 618-1652
aaagccacccagaggccgaggcgtcaaccctccgtttccctcccggtgctccttccagcgcccggtgtggtcgatttggcgggggtggagcgccaggcgcgtgcagagccgggcggaccagcctctccggccaaggcgggaggcggagctcgtactcaagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 197969 - DNA, 884 bp, Homo sapiens
  Payload ID: 19052
  Gene Name: UDP-Gal:betaGlcNAc beta 1,4- galactosyltransferase, polypeptide 4
  ENST ID: ENST00000475803
  CDS Start-End: 476-884
agtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagcttatcttccttgccagattttaaaaactattatggaaaatctcaagcattcacaaaagtagagagaaagaaaggactctcagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacc

SEQ ID NO: 197970 - DNA, 5794 bp, Homo sapiens
  Payload ID: 19052
  Gene Name: UDP-Gal:betaGlcNAc beta 1,4- galactosyltransferase, polypeptide 4
  ENST ID: ENST00000467604
  CDS Start-End: 393-1298
agtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggtaagtcctggcttcacctgcctagcaggctacctccctagtctgttctgtcaataaggactatgttgaattcgatcagatttgagccagttcattgtgttaaaagatttttattaagcaaattttcaaacagacacaaaaggagagaaagtggtgcactgaaccctcacgtctacagttctcaactcatggcctctcttctttccctcagtttttttcttaccccactggatttagaaatgtgtcacagatgtcatagcatttcatgtgtaactgcttcagtatgtattcttaaaatataagcaattttaaaaaaggaatcagaataccattatcatacctagaataaaattaacaatatctccttaatgtcatcaaatgtctagtcagtgttaagtacttttttatttttaaaaccagttgatcagatcagtgtctaaacaaggtccacattgcatttgaatgatctcttttaatatgtaggttccctctccctttctttatgtgttccttgatatttatttgtggaacaagccagattatttgtccaatagaattccttgcattatggatttttccaattgcatcctggtagtataacttaatatgtcctcctgacctctattttctcataaactggttgtattagtcagggttctctagagggacagaacgaacaggatagatgtatatatgaaggggagtttattaaggagtattgactcacactatcccaagatgaagtccacaataggccgcctgcaagctgaggaacgaggaagccagcccgggtcccaaaacctcaaaagtagggaagccaacagggcagccttcagtctgtggccaaaggcccgagagtccctggcaaaccactggtgtaggtccaagagtccagaagctgaagaacttggagtctgatgttcagggtcaggaagcccaggagaaagatgaaggccagaagactcagcaagttggcttctcccttcttctgcctgctttattttagcctcgctagcagttgattagatggtgcccacccacatggagggtagatctgcccctcccagtccactgactcaaatgttaatttcctttggcaacaccctcacagacacacccaggaacaatacttcacatccttcaatccaatcaagttgacactcagtattaaccatcacactgggatttctctgcatttctggagacttgaacagaatcttatttttgggcaagaattttcatttatggtgttgtgtacttcctccagtgtcacaacaggaggatgtaatgtctggttgtgtcattttgtgatgttaggattgatctgtgagtttcgatattgccagtctaatctatgcattgtgagattcctcatcagttttttacctaatgacttcagcagtcattgatgcttgatttctaaatttattatttaattaggagttgcaaaattgtaatattctaattctattgttccttctgcatttattagatttttctacaaagtactttcccttttcatgtatttgggtactctggggtatagtttttataggaaaggcagaataaagagaaaagagtcaagcactgattaaaaatttttcagactaatgacttggtgtttcctagcatccttcaggatgtagttcttgtactttttggtactcatattgtctcatctttggccaatgggatcttcttcaagctgggtcctgaatcccagtagtcctcgagagcttccctccctgtgctctgctgtgatgaaatgttctaggctcttcttgtacttttcctgccttgggaattggcctattcacaaggaatcctggcagataagccagttcttatgaggctttgattgaagaatctgtatttctttgttctgatttttccccttaaattttcaaacagtcttaaggggtttttagtgcttttgttatagtctacattttaaaacaatattaaagtgcttttagcctgatattaaacagtcctgttaaagttcatttatttttttctgaggcagggtctcgctcccaagctggagtgcagtggcgtgaccatggctcactacagcctcgatctctcaggctcaagcaatcctccaagctcagcctcccaagtagctgggaccacaggcatgtgtcaccatgcttggctaatttttttttattttttgtaaagacagggtcttcctgtgttgccaaaggctggtcttaaactcctgggctcaagcagtcctcctgcctcagcctcccaaagttctaggattacagcatgagctaccatgcctggcctaaagtttatattttaaagcattattaaatggcttttcacccttttggtagagtcaaccactccaacaaaatagctatttctattttctatgtttttctagtcattgtccataggtatgcatttttctctttatgttaaaaaaattaattattgagtagatacaaaagagtattcctaaattgtatgaaaagtatgaagattcttgatgccatgaacactgctgatatctcctacccccactttgagtgcatgacctgtgtggtcctccctaattctgtagtctcctccttcacatctcccctatccacctacccaagtaacacttctctgaatttttgtgataagtatttgtgataatgatagttatttctgctgtttcttggttttcttgttttcccatatgtttgtatccctaaacaaaagattgcttagttctgcatgtttttcaactttatgtaaatgaaatcacactgcatttattcttctctgactttatttagctgaacattatgcatctgatccccatccatattgtcatgggtaactagcatttattgtcttcactgctgaacaagtagaacctattcagttcactgcccacttgtcttcccagattccatggttctggccacactagtgacttctttaaatgcatcctgctcttttgcgtctgtgcatcttgcccagggtggtctctctgcctggagtgctttttccttcaccttcttcacttggtggatttctctctttcagcgttactgaaattttccttctccctgacacctcacccgacttcctcatgaagttaggtctcccttcattcatcctcatctacatacattctaatttttttggaggctcgtgaaagctatgtacccacctacagacaaactttccttataacataggaagattcagagatcccctgaagctcagccaaggatcagttagcaatggttggtacatatcctgtagtatctgtattccttgcacatccttctgtcctgtagactgggggctcactgagtgcagtgacacttttcatcatgggtccccgggttctcacgtggagtctgacacatgaatacatggctatcatgtctgtcaccttcaatggggcaaacaaactttgtaatggtaggaaacacaacaggtacaataatttacaaaaatatgtttgccacatttcagggcaaggcaaaatgcagtggagacatatgttaaattcttatcattcacatttgttctttttatctttaggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagctt

SEQ ID NO: 197971 - DNA, 712 bp, Homo sapiens
  Payload ID: 19052
  Gene Name: UDP-Gal:betaGlcNAc beta 1,4- galactosyltransferase, polypeptide 4
  ENST ID: ENST00000471675
  CDS Start-End: 96-284
tgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 197972 - DNA, 615 bp, Homo sapiens
  Payload ID: 19052
  Gene Name: UDP-Gal:betaGlcNAc beta 1,4- galactosyltransferase, polypeptide 4
  ENST ID: ENST00000479150
  CDS Start-End: 260-615
agtgctagctcgccgcggccgcctccggggtgagtacgctggctccgccggcgcccgggaaatgcagttccctggacacgggcgccgtgcgagggtagccgggcgacggccgggactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaa

SEQ ID NO: 197973 - DNA, 582 bp, Homo sapiens
  Payload ID: 19052
  Gene Name: UDP-Gal:betaGlcNAc beta 1,4- galactosyltransferase, polypeptide 4
  ENST ID: ENST00000459820
  CDS Start-End: 575-582
agtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagtctcctccaatctgaaatagttcctcagtttttcctcgtctttcatgattttgattcttcgaagagtaccagttaggtatatcgtggaatgaacttgtgcttatcttccttgccagattttaaaaactattatggaaaatctcaagcattcacaaaagtagagagaaagaaaggactctcagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggctt

SEQ ID NO: 197974 - DNA, 588 bp, Homo sapiens
  Payload ID: 19052
  Gene Name: UDP-Gal:betaGlcNAc beta 1,4- galactosyltransferase, polypeptide 4
  ENST ID: ENST00000493932
  CDS Start-End: 464-588
acggaggccgagcctggcgggaggcaccggctcaggtgctggcgttccgcgcggcgccgcctctgctgcgggccgggggagccagacgaggtgctgccgggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcc

SEQ ID NO: 197975 - DNA, 611 bp, Homo sapiens
  Payload ID: 19052
  Gene Name: UDP-Gal:betaGlcNAc beta 1,4- galactosyltransferase, polypeptide 4
  ENST ID: ENST00000459778
  CDS Start-End: 592-611
gctttccgcgttctcccctctccgcgggcagtgctagctcgccgcggccgcctccggggtcacgattccggggtcgcccccagcacttctccgccgggtgcatcaacctgaaaaagccccttcttcctggaaaccctccttctccagcgtttcaacggggaaactgatcagctgacaccagccccagtcctgcgaggggccggcgacctttgacctttctccaaaggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgacttt

SEQ ID NO: 197976 - DNA, 560 bp, Homo sapiens
  Payload ID: 19052
  Gene Name: UDP-Gal:betaGlcNAc beta 1,4- galactosyltransferase, polypeptide 4
  ENST ID: ENST00000473887
  CDS Start-End: 496-560
gtgcacactgttgcaaagtgttccagagtgggtgagggatggggacgtggcggtggtgagggtactggtagacctcctcagccgtttggtgatgaaaaggaggaaaaagaaaatggtaatctgagcgtggaggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtg

SEQ ID NO: 197977 - DNA, 563 bp, Homo sapiens
  Payload ID: 19052
  Gene Name: UDP-Gal:betaGlcNAc beta 1,4- galactosyltransferase, polypeptide 4
  ENST ID: ENST00000491906
  CDS Start-End: 489-563
agtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagcttatcttccttgccagattttaaaaactattatggaaaatctcaagcattcacaaaagtagagagaaagaaaggactctcaggaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccag

SEQ ID NO: 197978 - DNA, 2494 bp, Homo sapiens
  Payload ID: 19052
  Gene Name: UDP-Gal:betaGlcNAc beta 1,4- galactosyltransferase, polypeptide 4
  Uniprot ID: O60513
  ENST ID: ENST00000483209
  CDS Start-End: 643-1677
accggctcaggtgctggcgttccgcgcggcgccgcctctgctgcgggccgggggagccagacgaggtgctgccgggtaggaaaaaatccagggctcattcataccccaggtcacgattccggggtcgcccccagcacttctccgccgggtgcatcaacctgaaaaagccccttcttcctggaaaccctccttctccagcgtttcaacggggaaactgatcagctgacaccagccccagtcctgcgaggggccggcgacctttgacctttctccaaaggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagctttgagtgtt

SEQ ID NO: 197979 - DNA, 641 bp, Homo sapiens
  Payload ID: 19052
  Gene Name: UDP-Gal:betaGlcNAc beta 1,4- galactosyltransferase, polypeptide 4
  ENST ID: ENST00000470111
  CDS Start-End: 478-641
agtgctagctcgccgcggccgcctccggggtgagtacgctggctccgccggcgcccgggaaatgcagttccctggacacgggcgccgtgcgagggtagccgggcgacggccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccct

SEQ ID NO: 197980 - DNA, 2107 bp, Homo sapiens
  Payload ID: 19052
  Gene Name: UDP-Gal:betaGlcNAc beta 1,4- galactosyltransferase, polypeptide 4
  ENST ID: ENST00000480814
  CDS Start-End: 365-1105
ggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatat

SEQ ID NO: 197981 - DNA, 4722 bp, Homo sapiens
  Payload ID: 19053
  Gene Name: UDP-Gal:betaGlcNAc beta 1,4- galactosyltransferase, polypeptide 5
  Uniprot ID: O43286
  ENST ID: ENST00000371711
  CDS Start-End: 189-1355
atgtggcccggcccgcgacggccggcggctgggagcggcgaggcggcggcggcggcgagtggcggcccgcgaggcccgggaggcggtggccgaggcccaggcggtggcggcggcggcccaggaggcggcggacggggagctgcgggagcaggcccggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcttgcagtttgcattttatgtggttgaacaagttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtccctttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacaggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaa

SEQ ID NO: 197982 - DNA, 2128 bp, Homo sapiens
  Payload ID: 19054
  Gene Name: UDP-Gal:betaGlcNAc beta 1,4- galactosyltransferase, polypeptide 6
  ENST ID: ENST00000237019
  CDS Start-End: 146-1177
ctcgggccctctccccagagcctccccgcgcggaccccgctgcagtctcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaa

SEQ ID NO: 197983 - DNA, 3891 bp, Homo sapiens
  Payload ID: 19054
  Gene Name: UDP-Gal:betaGlcNAc beta 1,4- galactosyltransferase, polypeptide 6
  Uniprot ID: Q9UBX8
  ENST ID: ENST00000306851
  CDS Start-End: 298-1446
ccggctttcttccgtcctgccgtccccgggcccctagcccccagtcccctctcccccctccacctcttgtccctcggcctccgcgcctcccctcccccgactctctggcctcccattcattccgtccgctccctcccatttcctcttttccgctcgggccctctccccagagcctccccgcgcggaccccgctgcagtctcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacgtgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaatta

SEQ ID NO: 197984 - DNA, 1239 bp, Homo sapiens
  Payload ID: 19054
  Gene Name: UDP-Gal:betaGlcNAc beta 1,4- galactosyltransferase, polypeptide 6
  Uniprot ID: Q9UBX8
  ENST ID: ENST00000383131
  CDS Start-End: 79-1110
atggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagt

SEQ ID NO: 197985 - DNA, 339 bp, Homo sapiens
  Payload ID: 19054
  Gene Name: UDP-Gal:betaGlcNAc beta 1,4- galactosyltransferase, polypeptide 6
  ENST ID: ENST00000579372
  CDS Start-End: 125-339
aggggggattcattaatccaggtcggaaatacaccttgttcctcgaggattttggaaggaaattccacccgcgaagtccccttttggagatgcccttttcctttcagccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcg

SEQ ID NO: 197986 - DNA, 1488 bp, Homo sapiens
  Payload ID: 19055
  Gene Name: UDP-galactose-4-epimerase
  Uniprot ID: Q14376
  ENST ID: ENST00000374497
  CDS Start-End: 93-1139
gcgacggctgagcaaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactgg

SEQ ID NO: 197987 - DNA, 876 bp, Homo sapiens
  Payload ID: 19055
  Gene Name: UDP-galactose-4-epimerase
  ENST ID: ENST00000425913
  CDS Start-End: 293-876
actcctagctcggccccgctccgcgctacagcccaaagcccagcctgagacccagccgccctcgtatgcccacggcctagctccccttccctccaacagacagactgggaaaaccgagtgggcgacggctgagcaaggtcactccgctgtcgggggcgcagccggcctcagaccagctttcgtgcttcccagggcctctctgcgaccactttcggggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctgg

SEQ ID NO: 197988 - DNA, 672 bp, Homo sapiens
  Payload ID: 19055
  Gene Name: UDP-galactose-4-epimerase
  ENST ID: ENST00000456977
  CDS Start-End: 1-327
gtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttaca

SEQ ID NO: 197989 - DNA, 792 bp, Homo sapiens
  Payload ID: 19055
  Gene Name: UDP-galactose-4-epimerase
  ENST ID: ENST00000445705
  CDS Start-End: 211-792
attagtcactgcgcccaggagccagtttacacctagcgaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctct

SEQ ID NO: 197990 - DNA, 957 bp, Homo sapiens
  Payload ID: 19055
  Gene Name: UDP-galactose-4-epimerase
  ENST ID: ENST00000429356
  CDS Start-End: 240-957
gaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatcccgtacaaggtggtggcacggcgggaaggtgatgtggcagcctgttacgccaaccccagcctggcccaagaggagctggggtggacagcagccttagggctggacaggatgt

SEQ ID NO: 197991 - DNA, 882 bp, Homo sapiens
  Payload ID: 19055
  Gene Name: UDP-galactose-4-epimerase
  ENST ID: ENST00000418277
  CDS Start-End: 202-882
ggctcgggcgtaggaggcggtgcctctgcagcaagcgtggggcgcgggaacccgagcaggactctccagtcctcagtcaccttggacaaagaagtgtggatcctcagattccatcttttccaactccaaggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaag

SEQ ID NO: 197992 - DNA, 1566 bp, Homo sapiens
  Payload ID: 19055
  Gene Name: UDP-galactose-4-epimerase
  Uniprot ID: Q14376
  ENST ID: ENST00000617979
  CDS Start-End: 170-1216
gccggagtgggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 197993 - DNA, 2763 bp, Homo sapiens
  Payload ID: 19056
  Gene Name: UDP-GlcNAc:betaGal beta-1,3-N-acetylglucosaminyltransferase 2
  Uniprot ID: Q9NY97
  ENST ID: ENST00000301998
  CDS Start-End: 253-1446
ggagcctggagtgaggcgcagcggcagcggcagcagcggcaacaagtgccggaggctagcagagccaagccggagcagtccctgccgccgacaccgccgggccgcccgtccggggcgccgcgcatggagcgtgagctgcggcggtcgccgggctgagccgcgcggagcggccgggacgtggatgtggccgcgatctcccgcccttgcccccgccccgccgagctggagctgctcccggacaagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaattctgccaaactattacttatatgtactattgtgtaacatactttcttgaaatatttttgtttatagaattgaaggttcttatcagatgggatactggggactataaacaatggaaataaagccactgtatttttaa

SEQ ID NO: 197994 - DNA, 2436 bp, Homo sapiens
  Payload ID: 19056
  Gene Name: UDP-GlcNAc:betaGal beta-1,3-N-acetylglucosaminyltransferase 2
  Uniprot ID: Q9NY97
  ENST ID: ENST00000405767
  CDS Start-End: 108-1301
agagccatttagctgcaaactgtctctgtctctgtttatccgagcagaacctggaaggggctggcaaggactaggcaacagatgggacagccagagagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaa

SEQ ID NO: 197995 - DNA, 2226 bp, Homo sapiens
  Payload ID: 19057
  Gene Name: UDP-GlcNAc:betaGal beta-1,3-N-acetylglucosaminyltransferase 3
  Uniprot ID: Q9Y2A9
  ENST ID: ENST00000318683
  CDS Start-End: 148-1266
agaggggcgggagctctggctcaggtaaaaactctttcttcggctcgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacgcctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgtagcccccagcttcaggcctcagtgtctgccagtcaagcttcacaggcattgtgatggggcagccttggggaatataaaattttgtgaagacttgga

SEQ ID NO: 197996 - DNA, 470 bp, Homo sapiens
  Payload ID: 19057
  Gene Name: UDP-GlcNAc:betaGal beta-1,3-N-acetylglucosaminyltransferase 3
  ENST ID: ENST00000600777
  CDS Start-End: 89-470
aaaaactctttcttcggctcgcgagctgagaggagcaggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggc

SEQ ID NO: 197997 - DNA, 856 bp, Homo sapiens
  Payload ID: 19057
  Gene Name: UDP-GlcNAc:betaGal beta-1,3-N-acetylglucosaminyltransferase 3
  ENST ID: ENST00000599265
  CDS Start-End: 107-856
gcttgttcatctccagccacggggagctcattccctagcagcgggccagacccaaggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagc

SEQ ID NO: 197998 - DNA, 1349 bp, Homo sapiens
  Payload ID: 19057
  Gene Name: UDP-GlcNAc:betaGal beta-1,3-N-acetylglucosaminyltransferase 3
  Uniprot ID: Q9Y2A9
  ENST ID: ENST00000595387
  CDS Start-End: 120-1238
cgagctgagaggagcaggtagaggggcagaggcgggactgtcgtctggggtgagttttgttttccacaggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacgcctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccaggga

SEQ ID NO: 197999 - DNA, 1642 bp, Homo sapiens
  Payload ID: 19058
  Gene Name: UDP-GlcNAc:betaGal beta-1,3-N-acetylglucosaminyltransferase 4
  Uniprot ID: Q9C0J1
  ENST ID: ENST00000324189
  CDS Start-End: 357-1493
agcagcctctgcccgacccggctcgtgcggaccccaggaccgggcgcgggacgcgtgcgtccagcctccggcgctgcggagacccgcggctgggtccggggaggccccaaacccgcccccgccagaaccccgccccaaattcccacctcctccagaagccccgcccactcccgagccccgagagctccgcgcacctgggcgccatccgccctggctccgctgcacgagctccacgcccgtaccccggcgtcacgctcagcccgcggtgctcgcacacctgagactcatctcgcttcgaccccgccgccgccgccgcccggcatcctgagcacggagacagtctccagctgccgttcatgcttcctccccagccttccgcagcccaccagggaaggggcggtaggagtggccttttaccaaagggaccggcgatgctctgcaggctgtgctggctggtctcgtacagcttggctgtgctgttgctcggctgcctgctcttcctgaggaaggcggccaagcccgcaggagaccccacggcccaccagcctttctgggctcccccaacaccccgtcacagccggtgtccacccaaccacacagtgtctagcgcctctctgtccctgcctagccgtcaccgtctcttcttgacctatcgtcactgccgaaatttctctatcttgctggagccttcaggctgttccaaggataccttcttgctcctggccatcaagtcacagcctggtcacgtggagcgacgtgcggctatccgcagcacgtggggcagggtggggggatgggctaggggccggcagctgaagctggtgttcctcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagccctgcccaacaggaacactaaggtcaaatacttcatcccaccctcaatgtacagggccacccactacccaccctatgctggtgggggaggatatgtcatgtccagagccacagtgcggcgcctccaggctatcatggaagatgctgaactcttccccattgatgatgtctttgtgggtatgtgcctgaggcggctggggctgagccctatgcaccatgctggcttcaagacatttggaatccggcggcccctggaccccttagacccctgcctgtatagggggctcctgctggttcaccgcctcagccccctcgagatgtggaccatgtgggcactggtgacagatgaggggctcaagtgtgcagctggccccataccccagcgctgaagggtgggttgggcaacagcctgagagtggactcagtgttgattctctatcgtgatgcgaaattgatgcctgctgctctacagaaaatgccaacttggttttttaactcctctcaccctgttagctctgattaaaaacactgcaaccca

SEQ ID NO: 198000 - DNA, 2749 bp, Homo sapiens
  Payload ID: 19058
  Gene Name: UDP-GlcNAc:betaGal beta-1,3-N-acetylglucosaminyltransferase 4
  Uniprot ID: Q9C0J1
  ENST ID: ENST00000546192
  CDS Start-End: 131-1192
attcccacctcctccagaagccccgcccactcccgagccccgagagctccgcgcacctgggcgccatccgccctggctccgctgcacgagctccacgcccgtaccccggcgtcacgctcagggaccggcgatgctctgcaggctgtgctggctggtctcgtacagcttggctgtgctgttgctcggctgcctgctcttcctgaggaaggcggccaagcccgcaggagaccccacggcccaccagcctttctgggctcccccaacaccccgtcacagccggtgtccacccaaccacacagtgtctagcgcctctctgtccctgcctagccgtcaccgtctcttcttgacctatcgtcactgccgaaatttctctatcttgctggagccttcaggctgttccaaggataccttcttgctcctggccatcaagtcacagcctggtcacgtggagcgacgtgcggctatccgcagcacgtggggcagggtggggggatgggctaggggccggcagctgaagctggtgttcctcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagccctgcccaacaggaacactaaggtcaaatacttcatcccaccctcaatgtacagggccacccactacccaccctatgctggtgggggaggatatgtcatgtccagagccacagtgcggcgcctccaggctatcatggaagatgctgaactcttccccattgatgatgtctttgtgggtatgtgcctgaggcggctggggctgagccctatgcaccatgctggcttcaagacatttggaatccggcggcccctggaccccttagacccctgcctgtatagggggctcctgctggttcaccgcctcagccccctcgagatgtggaccatgtgggcactggtgacagatgaggggctcaagtgtgcagctggccccataccccagcgctgaagggtgggttgggcaacagcctgagagtggactcagtgttgattctctatcgtgatgcgaaattgatgcctgctgctctacagaaaatgccaacttggttttttaactcctctcaccctgttagctctgattaaaaacactgcaacccagctaacttgtccagcatatgttgaatgggagccaaagtgtagcaaatgctgccaggaacctgtcggggcattccgggcgctgcctggggcgctgcagtctgggacctcaaggaaggaggctgcataggaccccaggagagacgcattttctctttcagatgcaaacaaaatcttacactcttctcctttggatacaatagagaaacggaaagaaaggaaggaacaagaggcctgtgttaagtcctgttgatgttaagtcctgttgagagcaccaggtaaacactctgcaccccttctcttagtagtaataggtttttcactccttggcctcagctgtcctcacaggacagtgggggcagatcagagaacacatcagaaatacatacaaagaaatcgtacaaactggacaggttcccctccccctgccacaactggcatcccaacagagggaacaagtactaaatcatttttgacgacgtaaataagactgaaaacaggttaaacagttgctgaacttaagggcatgacaaaaaggactcctctctctgacccaggtaggcaaaatgctttgggtgtgaggtaaaaaaaatgggtaagagcagctgtacagagtggggtgaaatgttaaacagggtgcagtgcccaagggctaagaaccaggtccagcgcaagcctgagaccacaggaggcactcacagctcacaaaggcgtctcgcctgattggccagggcaggatctgccgcctcttctcggtgcacagacagtcatgccaaccctgggcagggtggcatctgcccctgctttccccactgagtggggagacagggcagtgtgctcaggccctcaatcctcacgcaggtaggcctcctgctccgactcagcccgctcctccccttcctcctgtgttttctgacggagctcttctatctgtgcttctgccagcttggtttctgctttccgggagagctggtgcacctcttccacctgcagtttcaccagctgaatgtgattcctggcggttatagaggcctgatctgcgcctgccaaaagatgggacaatcgggttgagcagccgtgcagggcgcggaaggctcatgtggacgttggcctgggggtgctgtggctgtcatctgaacccctcttggggtcactttccttgacctccctgtcttctctctctgcaaagaaacttccacctctatgttcaggtctggatttaactgacactctgtcaaaaacagcatttttcttcagctgtcagcggccaacatcacaattattaaatgcaactctcacaatcatctttatagctacagagcttttagtacagacctttgattaatttttttaactacacatcttccatttctttttgacaaagagatcatgaataaaattgtcaaagatc

SEQ ID NO: 198001 - DNA, 2938 bp, Homo sapiens
  Payload ID: 19058
  Gene Name: UDP-GlcNAc:betaGal beta-1,3-N-acetylglucosaminyltransferase 4
  Uniprot ID: Q9C0J1
  ENST ID: ENST00000535274
  CDS Start-End: 1728-2789
cagtctccagctgccgttcatgcttcctccccagccttccgcagcccaccagggaaggggcggtaggagtggccttttaccaaaggtcagattctttcaccgcctctgccagacccccttgtcccccacccccgcatagatctccagggggctcagaaaactctggccggtggctcacgcctgtagtcccaacgctttgggaggccaaggcgggaggatcgcttgaggccaggagttccagaccagcccaggcaacaaaagataccacatctctacaaaaaataaattagccgggccctgcacgcctgtagtcccagctactggggaggccgaggccggaggatcgcttgaacccaggagttccaggctgcagtgagctataattgtgccactgcactagagtctgggtgacagagacactgtctcaaaaaaaaccaacaaaacccttagctctttcactagccgggctggcctcttcctactgtaaacctgctgggcccccgtctcccttctttctcccctctctcctgccctggagctgcctgactctgcccacggcctgcagagaccccaggtcttcacgcaaggtgccattcctcactcagttcttgctcaaacgtccctccatcaaggagggctttttagctacccttggctatgggatccgtcctccgcgtcagccaattctctgcattagactgtaacttctcaacatacctggttcctatgcgttttgtgctcccctctgagagggcagcgaccctgtcttgcttgccactgcatccctagcacctagcagttgcttttctggtgacggcggctgtggcagtggccaatgcggcagactggtcagaagtgaagggacaggatgacttggcagtggaggtcaaggggaggggactggggcagagggagacaccagagggacaaaaatgagaaactgaagacaggctttgctacgtggagctcgggcaggccacactggtggattctgtctcctcatccttcttttcaggtccctgggagaaatcagcacttagaacgtggtgggaaggcggggcggggtgcctcggaagccatccctgatacaagtccccagctttcctgcttcccctcttgtggtgtgtggctttgtctccctccctccctcctggaagccccgacctctgaggcaggtgtaaagggtgtgtgctttggtggccacggccaccctgtggtgctggttctcctccgagggaagcagtgcactcctggtcatcttggagacgcccaacacaggaccccacaggcaccaagctttttttgggaaatggtttcacttcccacttgaaaagccctgaatgtcagttccacacttagtgaatttgatccaagctaaactgagtctgtgcctaaaactcatcaggtgctcgagtttcctggaagaatggctgggaacgtttatggtgtcagctgtaaagtggctgcaagtccttttgggaaaaacagacccaggagtcctcagatgatggcagaggagggcaagggctggcaaagcagctgtgcttagcccatcctcaggggagggaggactctggaaagagcctgaggatacgctgagaataaaaagtccagaggccagcagggacttagcggctggggtgcaggttaactcctgcccaactcttggggacagggacccggggctgggccctgctcaggtggctctctccttgcagggaccggcgatgctctgcaggctgtgctggctggtctcgtacagcttggctgtgctgttgctcggctgcctgctcttcctgaggaaggcggccaagcccgcaggagaccccacggcccaccagcctttctgggctcccccaacaccccgtcacagccggtgtccacccaaccacacagtgtctagcgcctctctgtccctgcctagccgtcaccgtctcttcttgacctatcgtcactgccgaaatttctctatcttgctggagccttcaggctgttccaaggataccttcttgctcctggccatcaagtcacagcctggtcacgtggagcgacgtgcggctatccgcagcacgtggggcagggtggggggatgggctaggggccggcagctgaagctggtgttcctcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagccctgcccaacaggaacactaaggtcaaatacttcatcccaccctcaatgtacagggccacccactacccaccctatgctggtgggggaggatatgtcatgtccagagccacagtgcggcgcctccaggctatcatggaagatgctgaactcttccccattgatgatgtctttgtgggtatgtgcctgaggcggctggggctgagccctatgcaccatgctggcttcaagacatttggaatccggcggcccctggaccccttagacccctgcctgtatagggggctcctgctggttcaccgcctcagccccctcgagatgtggaccatgtgggcactggtgacagatgaggggctcaagtgtgcagctggccccataccccagcgctgaagggtgggttgggcaacagcctgagagtggactcagtgttgattctctatcgtgatgcgaaattgatgcctgctgctctacagaaaatgccaacttggttttttaactcctctcaccctgttagctctgattaaaaacactgcaaccca

SEQ ID NO: 198002 - DNA, 4123 bp, Homo sapiens
  Payload ID: 19059
  Gene Name: UDP-GlcNAc:betaGal beta-1,3-N-acetylglucosaminyltransferase 5
  Uniprot ID: Q9BYG0
  ENST ID: ENST00000326505
  CDS Start-End: 531-1667
atcccgcccgcatacagcccgcatcccgccggggaagcgagcccagtccagcgctgcccgtccagtcctcgcccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaattatcatga

SEQ ID NO: 198003 - DNA, 614 bp, Homo sapiens
  Payload ID: 19059
  Gene Name: UDP-GlcNAc:betaGal beta-1,3-N-acetylglucosaminyltransferase 5
  ENST ID: ENST00000481531
  CDS Start-End: 465-614
attcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatac

SEQ ID NO: 198004 - DNA, 1766 bp, Homo sapiens
  Payload ID: 19059
  Gene Name: UDP-GlcNAc:betaGal beta-1,3-N-acetylglucosaminyltransferase 5
  Uniprot ID: Q9BYG0
  ENST ID: ENST00000465010
  CDS Start-End: 524-1660
tgcacccacagcagtctgttgtggatggttgctgagctgcgcattcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtgagcgccagttgtatgtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaa

SEQ ID NO: 198005 - DNA, 684 bp, Homo sapiens
  Payload ID: 19059
  Gene Name: UDP-GlcNAc:betaGal beta-1,3-N-acetylglucosaminyltransferase 5
  ENST ID: ENST00000464923
  CDS Start-End: 441-684
gaacgccgcgcccaccaattcggttgccggccgggggccccaggcttgcggccacccgcctccggctggagggctgaattcgagtcgaaagcccgtgtcgggctggaaagaagaaaccgccaacctgagaacgctttcggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaa

SEQ ID NO: 198006 - DNA, 608 bp, Homo sapiens
  Payload ID: 19059
  Gene Name: UDP-GlcNAc:betaGal beta-1,3-N-acetylglucosaminyltransferase 5
  ENST ID: ENST00000464191
  CDS Start-End: 423-608
agtttgctgtaagtttccttactttgttactgaggcccccagagctccacgcataagtggtgtgaccagaaaccttttaacaagacccgcctgagcctgcgttagagctcccgctcggaaagtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctg

SEQ ID NO: 198007 - DNA, 3368 bp, Homo sapiens
  Payload ID: 19059
  Gene Name: UDP-GlcNAc:betaGal beta-1,3-N-acetylglucosaminyltransferase 5
  Uniprot ID: Q9BYG0
  ENST ID: ENST00000460419
  CDS Start-End: 741-1877
ctgggccggtggttccgcgcggagttagtctgtggtcagttacgtggtgaaaacacggctgtgccgcggccgcatctttccgcggccgaggcctctctgggtgggagtgttggcttcctttccggatcgctaaatggggaaagttctggccgctcggcgggatacgtctccaggccacggatggttcgttctccgtgccgcggccccgagctgggctccctgggtctccagcgcgggctcccggcattgggggctgcgggccggcccctccgccccgcccccgccccgccgcgcctcctcggccgagcggctcgcggtctccggcgcgggaggctccgagtctgcccactccgggccgagcgaggtctctggaggagaagagtggcgaggaggtgagggcacgccggccctcgcccggcgggtggcgccaggacttcaggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgc

SEQ ID NO: 198008 - DNA, 568 bp, Homo sapiens
  Payload ID: 19060
  Gene Name: UDP-GlcNAc:betaGal beta-1,3-N-acetylglucosaminyltransferase 6
  ENST ID: ENST00000528622
  CDS Start-End: 205-568
agtgtgtgaagtaaagggattaaaggctagtctcaggctggggatggctcctgtctatttcttctctctcagagactgcagctgcgggaggggagaggtcggccgagagcaagatggtgtgtagagacaccaagcaggacgctacttcatgtgaggcgggaatgttagtttggatcaacctgttgatagagggaatgaaagcagatggcttttccctgccgcaggtccctgactgccaagactctggcctgcctcctggtgggcgtgagtttcttagcactgcagcagtggttcctccaggcgccaaggtccccgcgggaggagaggtccccgcaggaggagacgccagagggtcccaccgacgctcccgcggctgacgagccgccctcggagctcgtccccgggcccccgtgcgtggcgaacgcctcggcgaacgccacggccgacttcgagcagctgcccgcgcgcatccaggacttcctgcggtaccgccactgccgccacttcccgctgctttgggacgcaccggccaagtgcgccggcggccgaggcgtgttcctgctcctgg

SEQ ID NO: 198009 - DNA, 2503 bp, Homo sapiens
  Payload ID: 19060
  Gene Name: UDP-GlcNAc:betaGal beta-1,3-N-acetylglucosaminyltransferase 6
  Uniprot ID: Q6ZMB0
  ENST ID: ENST00000622824
  CDS Start-End: 82-1236
agtgtgtgaagtaaagggattaaaggctagtctcaggctggggatggctcctgtctatttcttctctctcagagactgcagatggcttttccctgccgcaggtccctgactgccaagactctggcctgcctcctggtgggcgtgagtttcttagcactgcagcagtggttcctccaggcgccaaggtccccgcgggaggagaggtccccgcaggaggagacgccagagggtcccaccgacgctcccgcggctgacgagccgccctcggagctcgtccccgggcccccgtgcgtggcgaacgcctcggcgaacgccacggccgacttcgagcagctgcccgcgcgcatccaggacttcctgcggtaccgccactgccgccacttcccgctgctttgggacgcaccggccaagtgcgccggcggccgaggcgtgttcctgctcctggcggtgaagtcggcgcctgagcactacgagcgacgcgagctcatccggcgcacgtgggggcaagagcgcagctacggcgggcggccagtgcgccgcctctttctattgggcaccccgggccccgaggacgaggcgcgcgcggagcggctggcggagctggtggcgctggaggcgcgcgagcacggcgacgtgctgcagtgggccttcgcggacaccttcctcaacctcacgctcaagcacctgcacttgctcgactggctggctgcacgctgcccgcacgcgcgctttctgctcagcggcgacgacgacgtgttcgtgcacaccgccaacgtagtccgcttcctgcaggcgcagccacccggccgccacctgttctccggccagctcatggagggctccgtgcccatccgcgacagctggagcaagtacttcgtgccgccgcagctcttccccgggtccgcttacccggtgtactgcagcggcggcggcttcctcctgtccggccccacggcccgggccctgcgcgcggccgcccgccacaccccgctcttccccatcgacgacgcctacatgggcatgtgtctggagcgcgccggcctggcgcccagcggccacgagggcatccgacccttcggcgtgcagctgcctggcgcacagcagtcctccttcgacccctgcatgtaccgcgagttgctgctagtgcaccgcttcgcgccctacgagatgctgctcatgtggaaggcgctgcacagccccgcgctcagctgtgaccggggacaccgggtctcctgaggccagttgggcggcttcagccccgggcctccaaccatgtccatgctgagaaggcagctttcccgctctgggtaccttacgtcctgcccagctctgtgcacctgaaccccagctgcgcactgaaatcagctggggtggggggtgtggaaaatgcctacatcctggctccatctcccgaagtttcgatttgattagtctggggtggacccagacatgttaagtattttttaagttcctccagtgatgcgaatgtgcagctaggcctgaggaccactcggctagactatctcttcatcctcgcaaagccagctccaccgccctctctgcaagaattccgggcccctcgctcccacactcgggtcctcttgagcagtggagcaagggagacctgggagcgtgggagccaggatcagcgccccctgccatgtgcctacaaatgtcagttgtgatttccactgtttacaagtgagtggagctggagctgggctgacagtatcaggtggatcccgcttccccctcccccaagaagtcagccaacacgcagctgaggcgcatgtggtggccttcttcccaccactaccccagtacaccgtgaggtagaaatcttcaccgtgcaaagtggaaaccagaggcccggtcagacagtgactaatccagggccgtggcattcccagacagcacaccactgtggtcccctccacactcaccccaaccaaagctaatggcctagttgggtcctgcccgccaataatcacccccacgggtcagagacaggctccttgccggggtctgggcctcaggctcagtgggccttggacaacccagcagggagttccggggagtccgaagtggagaaaggctggtgggaacatggaggccagtgttggggagcctgtggaggcaggtgtgtagaattgtgttcgggaggtgggggatctgagaccgaagtggacagtggttaagattgtggggccgggcgaggtggctcacgcctgtaatcccagcactttgggaggctgaggaggtcggatcatgaggtcaagagttcgagaccagcctggccaatatggtgaaaccccgtctctattgggagtacaaaaattagccggccatagtggctcgtgcctgtaatctcagctatttgggaggctgaggcaggagaatcacttgaacctgggaggcggaggttgcagtgagccgagatcgtgccactgcactccagcctgggcgacagagcaagactgcatctcaaaaaaaaaaaaaaaaa

SEQ ID NO: 198010 - DNA, 3706 bp, Homo sapiens
  Payload ID: 19061
  Gene Name: UDP-GlcNAc:betaGal beta-1,3-N-acetylglucosaminyltransferase 7
  Uniprot ID: Q8NFL0
  ENST ID: ENST00000287590
  CDS Start-End: 262-1467
gcttggggagcctaggggccgtctcggagaaatggggtggtccccgccaggcggcggcggggcgggccctgggcgccgaaggggttaaggcacctgggccaccgcccctgccggcccctcctcccgcggccgggaagaggaaagtcgcggcgggggcgcggcccggtctccgtccccacccgcccgccgtcccgccggcccgagccgtggcgcccagagctgcgagccgctcgcccctccgccgctccggcccgggccgccatgtcgctgtggaagaaaaccgtctaccggagtctgtgcctggccctggccctgctcgtggccgtgacggtgttccaacgcagtctcacccctggtcagtttctgcaggagcctccgccacccaccctggagccacagaaggcccagaagccaaatggacagctggtgaaccccaacaacttctggaagaacccgaaagatgtggctgcgcccacgcccatggcctctcaggggccccaggcctgggacgtgaccaccactaactgctcagccaatatcaacttgacccaccagccctggttccaggtcctggagccgcagttccggcagtttctcttctaccgccactgccgctacttccccatgctgctgaaccacccggagaagtgcaggggcgatgtctacctgctggtggttgtcaagtcggtcatcacgcagcacgaccgccgcgaggccatccgccagacctggggccgcgagcggcagtccgcgggtgggggccgaggcgccgtgcgcaccctcttcctgctgggcacggcctccaagcaggaggagcgcacgcactaccagcagctgctggcctacgaagaccgcctctacggcgacatcctgcagtggggctttctcgacaccttcttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacagccgcatgaacaaggagccgtgctttttccgcgccatgctcgtggtgcacaagctgctgccccctgagctgctcgccatgtgggggctggtgcacagcaatctcacctgctcccgcaagctccaggtgctctgaccccagccgggctactaggacaggccagggcacttgctcctgagcccccatggtattggggctggagccacagtgcccaggcctagcctttggtccccaaggggaggtggagggttgaggcctacgtgccactgggtgtggtggggtgcaggtagccagaaagggacctccctgtgtggataattctaggaaactgaggcccaggaacggttggagctgcccagtctggaggccctctctgaggagcgaggcgccaggccctggcagccctcctgacctgggtccgttgctggccccctcagatgtggtgggaggtcctggtgacctctggaggaacgctgtgctcaggtacctgggctaggcctggcctgatgggtctgtggccgcccctcgtcttcacagggaagagtcttctgtgaaatgcctcagtctccccagaggccgggcggccctggcaggagaaactcaaccctgtgcgggctcacaggcaccccccagtccacaccctggtctcctgggagagagggcccagccggctctccgcagccccaggcctgcctggagacgggccgcctctgccacagggcctccactcctggctgtgtcctgtaaggtctggaagggcgaccgctctgactacctcagcgcccctcagaatctccctggggctgcagccctaccccaccccgacacagggcagaagagcagcgctcctggccccccgaagtcccagagctgctgacccccaccccaggcaagtctctcccgcagcccccacacccccaggcctggctccctggctggaaagcagccggtttggccctggaagtggacattcctctattactgtgaagttttatttatgaagaatttggagggagaaggctccaggcttcaggagggggtggtgtcctccctggccctcctcccttccctcccctcattccagctgcctgccctcagcacccccaggcccctcacagcccagccccctccagagccctgccccaccgcaccctgcttctccagggcctagcagaccagcatctgccccggtgaagggatggatcagctgtgggggtgggtgcagaaggttgccacctcctacctcagcgggagtcacctaggaaagatggagggattgacactattttctcaataaaatgggacttttttttttttttttttttttttttggtgtgaaacttcctgttcccagctgcatcagagagcctgtctggggccaaggttgccagagatttctgaagacacagcttgttccttgttcttggctggtgggtgcacaaggacttctggaagggatttagacggggctgagtgctaggattaaagtggggatgggagtacggcaacagaaaaacctgggagctagcaatgcacccagcccttgactgtgccctggtggacagccgagctgtggctctagcgtgagccagtgccttcctgtccctgccaagggtgaggccagagttggccccgaggctaatgtttcagtgggtgagattaggtcggccgtacagaggccggtgggctccctgacatcccttccaggcaacctgaaagcactgaaatagcttatggccctgtgccagggaccttggcccaagctgctgacctccagggtggggagggagctacccccaggagaagagtcactcagacagcagtatgagcaagccagccagcagctccgtgcctgcacccagctcaggggaatcccagggggttcagatgcccaggaaggaaaaggggacagcgctactgctatggaatgagaccaccacttctcctgttgtccttcccagcttctccccaacctccccttttccctagtttataagacaggagaaaagggagaaagcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtgtgtagcccccagtcacgttcctcacgcttacttgatctattatgaccctttcacgtggaccccttagagttgtaagctcttaaaagggctaggaatttctttttcggggagctcggctcttaagacgcgagtctgccgacgctcccggccgaataaaaacctcttccttctttaa

SEQ ID NO: 198011 - DNA, 1874 bp, Homo sapiens
  Payload ID: 19062
  Gene Name: UDP-GlcNAc:betaGal beta-1,3-N-acetylglucosaminyltransferase 8
  Uniprot ID: Q7Z7M8
  ENST ID: ENST00000321702
  CDS Start-End: 455-1648
tcttcctccagctgttcccacaggctccattattcaaactttgggggaggaaatcagggctggacagatcatcaactgctgctgctgacagactgtgttcctgccatgatggggacaggcctgccccaaaccaggctgtctcaccagaaaccagccctaacacgccagagccccatctctcaggtcggcctcctgccctcctccctccctccctccctccctctctcctgcctcagccccgccccggcccctggggccctccctgctcccgctccactcccctccccgcccctctggactggctgggcagggctgggccccgccggtcgacaacacaggggctggggcaggcagatcagagggagctgagggaggcctgacctgaggccggcacccggagctggcgggagccagacccagagctcccgcggccgccccttccctgggccgggtcatgcgctgccccaagtgccttctctgcctgtcagcactgctcacactcctgggcctcaaagtgtacatcgagtggacatccgagtcccggctcagcaaggcctaccccagccctcggggcaccccgccaagccccacgccagccaaccctgagcccaccctacctgccaacctctccacccgcctgggccagactatcccgctgccctttgcttactggaaccagcagcagtggcggctggggtccctgcccagtggggacagcactgaaacggggggctgccaggcttggggggccgccgccgccaccgagatccctgacttcgcctcctaccccaaggacctccgccgcttcttgctgtcagcagcctgccggagcttcccacagtggctgcctggaggtggtggcagccaagtctccagctgctcagatactgatgtcccctacctgctgttggccgtcaagtcagaaccagggcgctttgcagaacgacaggccgtgagagagacgtggggcagtccagctccagggatccggctgctcttcctgctagggtctccggtgggtgaggcggggcctgacctagactcactagtggcctgggagagccgtcgctacagtgacctgctgctctgggacttcctcgacgtcccattcaaccagacgctcaaagacctgctgctgctggcctggctgggccgccactgccccaccgtgagttttgtcttgcgagctcaggacgatgcctttgtacacacccctgccctgctggctcacctgcgggccctgccacctgcctcggcccgaagcctctacctgggtgaggtctttacccaggccatgcctctccggaagccaggaggacccttctatgtgcccgagtccttcttcgaaggtggctacccagcctatgcaagcgggggtggctacgtcattgccgggcgcctggcaccctggctgctgcgggcggcagcccgtgtggcacccttcccctttgaggacgtctacactggcctttgcatccgagccctgggcctggtgccccaggcccacccaggcttcctcacagcctggccagcagaccgcactgcggaccactgtgctttccgcaacctgctgctggtacggcccctgggcccccaggccagcattcggctctggaaacaactgcaagacccaaggctccagtgctgactctcattggggagggcggaggtgctgacctggcctgggcctctggggccggcccctggctcagcccctccttccaggtcttgatgggagggaggagggcccagaagctggacaacttaagccactccttggcctcccccagccaggggcctgggcaggaaagatggggtggtggactgtttttgcctactttttgtttttgaaaaacatgcactccccactctga

SEQ ID NO: 198012 - DNA, 2917 bp, Homo sapiens
  Payload ID: 19063
  Gene Name: UDP-GlcNAc:betaGal beta-1,3-N-acetylglucosaminyltransferase 9
  Uniprot ID: Q6UX72
  ENST ID: ENST00000449549
  CDS Start-End: 537-1745
ggatagttgggggagctaaccaggggagttgatgcttcttcccaatccccagaaaggcgaatttggggtgtgagcacccagaccagcccttcccagagggactgagagtgaggaggctccctctcagggattagtccccactctgaggccggagtgctcctggcgccggggcggagctgagctccagaagtctgggcgcgcacagctggagggtcacgtggcacggcaccggtcccccttcctgccaacgctgcatttggctcgggcccggtccatggcggcccctcggaccctgcgctgagccccggaggccagggcgtccggggctgcgccacttccgagggccgagcgctgccggtcccggcggtgcgacacggccgggaggaggagaacaacgcaaggggctcaaccgtcggtcgctggagccccccccggggcgtggcctcccgccccctcagctggggagggcggggctcgctgccccctgctgccgactgcgacccttacaggggagggagggcgcaggccgcgcggagatgaggaggaggctgcgcctacgcagggacgcattgctcacgctgctccttggcgcctccctgggcctcttactctatgcgcagcgcgacggcgcggccccgacggcgagcgcgccgcgagggcgagggagggcggcaccgaggcccacccccggaccccgcgcgttccagttacccgacgcgggtgcagccccgccggcctacgaaggggacacaccggcgccgcccacgcctacgggaccctttgacttcgcccgctatttgcgcgccaaggaccagcggcggtttccactgctcattaaccagccgcacaagtgccgcggcgacggcgcacccggtggccgcccggacctgcttattgctgtcaagtcggtggcagaggacttcgagcggcgccaagccgtgcgccagacgtggggcgcggagggtcgcgtgcagggggcgctggtgcgccgcgtgttcttgctgggcgtgcccaggggcgcaggctcgggcggggccgacgaagttggggagggcgcgcgaacccactggcgcgccctgctgcgggccgagagccttgcgtatgcggacatcctgctctgggccttcgacgacaccttttttaacctaacgctcaaggagatccactttctagcctgggcctcagctttctgccccgacgtgcgcttcgtttttaagggcgacgcagatgtgttcgtgaacgtgggaaatctcctggagttcctggcgccgcgggacccggcgcaagacctgcttgctggtgacgtaattgtgcatgcgcggcccatccgcacgcgggctagcaagtactacatccccgaggccgtgtacggcctgcccgcctatccggcctacgcgggcggcggtggctttgtgctttccggggccacgctgcaccgcctggctggcgcctgtgcgcaggtcgagctcttccccatcgacgacgtctttctgggcatgtgtctgcagcgcctgcggctcacgcccgagcctcaccctgccttccgcacctttggcatcccccagccttcagccgcgccgcatttgagcaccttcgacccctgcttttaccgtgagctggttgtagtgcacgggctctcggccgctgacatctggcttatgtggcgcctgctgcacgggccgcatgggccagcctgtgcgcatccacagcctgtcgctgcaggccccttccaatgggactcctagctccccactacagccccaagctcctaactcagacccagaatggagccggtttcccagattattgccgtgtatgtggttcttccctgatcaccaggtgcctgtctccacaggatcccaggggatgggggttaagcttggctcctggcggtccaccctgctggaaccagttgaaacccgtgtaatggtgaccctttgagcgagccaaggctgggtggtagatgaccatctcttgtccaacaggtcccagagcagtggatatgtctggtcctcctagtagcacagaggtgtgttctggtgtggtggcagggacttagggaatcctaccactctgctggatttggaaccccctaggctgacgcggacgtatgcagaggctctcaaggccaggccccacagggaggtggaggggctccggccgccacagcctgaattcatgaacctggcaggcactttgccatagctcatctgaaaacagatattatgcttcccacaacctctcctgggcccaggtgtggctgagcaccagggatggagccacacataagggacaaatgagtgcacggtcctacctagtctttcctcacctcctgaactcacacaacaatgccagtctcccactggaggctgtatcccctcagaggagccaaggaatgtcttcccctgagatgccaccactattaatttccccatatgcttcaaccacccccttgctcaaaaaaccaatacccacacttaccttaatacaaacatcccagcaacagcacatggcaggccattgctgagggcacaggtgctttattggagaggggatgtgggcaggggataaggaaggttcccccattccaggaggatgggaacagtcctggctgcccctgacagtggggatatgcaaggggctctggccaggccacagtccaaatgggaagacaccagtcagtcacaaaagtcgggagcgccacacaaacctggctataaggcccaggaaccatataggagcctgagacaggtcccctgcacattcatcattaaactatacaggatgaggctgtacatgagttaattacaaaagagtcatatttacaaaaatctgtacacacatttgaaaaactcacaaaattgtcatctatgtatcacaagttgctagaccaaaatattaaaaatgggataaaatt

SEQ ID NO: 198013 - DNA, 1383 bp, Homo sapiens
  Payload ID: 19064
  Gene Name: UDP-GlcNAc:betaGal beta-1,3-N-acetylglucosaminyltransferase-like 1
  Uniprot ID: Q67FW5
  ENST ID: ENST00000320865
  CDS Start-End: 15-1100
gccgaagcggcgggatgagcggagccggcgtgggcggggcgtccgaggagagccaggccatgcaggcccacgtgtctattatcctcccagtccacaacgctgaaccgtggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcggatgacgtcatgatgccccagcgggtgaggctgcaacacgaggctgccgttcagcacccgtcgagcatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaa

SEQ ID NO: 198014 - DNA, 459 bp, Homo sapiens
  Payload ID: 19064
  Gene Name: UDP-GlcNAc:betaGal beta-1,3-N-acetylglucosaminyltransferase-like 1
  ENST ID: ENST00000571218
  CDS Start-End: 14-175
ccgaagcggcgggatgagcggagccggcgtgggcggggcgtccgaggagagccaggccatgcaggcccacgtgtctattatcctcccagtccacaacgctgaaccgtggctggacgaatgtttgaggtctgttttgcaacaggactttgaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcgggttcccagggtggagagcctctgccaccctcctgtcccccgactcccgtcttcactggggaaccggccgcatggctgtccacgtgcacaggaagccacatggccttcccggaaccgccccgaggcctctgaactggggcct

SEQ ID NO: 198015 - DNA, 2446 bp, Homo sapiens
  Payload ID: 19064
  Gene Name: UDP-GlcNAc:betaGal beta-1,3-N-acetylglucosaminyltransferase-like 1
  ENST ID: ENST00000572977
  CDS Start-End: 1135-1686
agtgctggcgagaggcagagaagctggatcctcatgcatcactgagggtgagagacggcgcaaccactctggagactgtttggaagttcctgtaaaaactaaacatgtaactgttctgtgacccggcagttgctctcctgggcatttatcccagtggattgaagacgctgttcacagacaaacctgaacttgaatgttcgggatcgccagcacaggacctgactactgttacatgcagtgactggaagcctgtcctgggagccgaggagcagtgcgaaagccgggcacagaaggccgcctcctgcacgttcccggatcatgctctggagagcacagccacggcgtcgggatagcacagccacggcgtcgggatagcacagcggctgccgttgaggggctgccagtggctgtaaggggcgcctcgggtgctcgtgccctgggacatctggatctggactccatcatgtccctctcctggtgcggcgttgaccttgggtcctcgtgatgttaccaccagaggaagtggtgaagggcacagagggtctctctacagttgtttcttacagctgcaatgtgaattcacaattttctcaaagtaagtttaattaaaaaacaacaacaacaacaaatgcaaacagaagcctcccccaagcacgtcattaactgcattggtagaaaagaatcactcactacgcgtaaacgctacacaagttggagacagatccaggggcctcagatgcctcggtgtgacttcatcgcttcagagttaggagactggctcactgataccactctttggaccacagttacattttcactattgtctccttgttggtcttgggtgagacggaatcagctgcgtccgctgggacttgtgacctggggcctgtgctgtgagaacgtctactcgggaggctctgctggccctgggccctcacttggggtgggtgctgtttcctacggacgcgcccaggtgccctctctccagccagctcctcccactgcaagatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacagtgaaggcagaggcgtccaccccaagtcaccagagcgcaggtgcagagaggaaaagctgtcagctagtgccagcctccaagggccagcgctacccttcaacagctggaggcaccactgtgcgaggctttccacaccggcctccctcaggaacaagacatcctcaccaggcaggggtgaggtatgggctccaggactggcttcagcaggcaccaggctgaagaagagacaagacaagctcaggctggtcagctccaacacacaccattcccagccaggggaccctcacccctctgggccctgtgtggggactgacacggttcctgcaggaaaccatttgtgccgtttcccacacacccggcagcctgagctatgtggctgacaggtgctcatgactaacgtgtcctcggaagggcaccccatctggggagcgggaagggaggttcactgcactgctcttaacctgcattcacacgtttgaaatttttcctaataaaaatgtaaaaagcac

SEQ ID NO: 198016 - DNA, 1787 bp, Homo sapiens
  Payload ID: 19064
  Gene Name: UDP-GlcNAc:betaGal beta-1,3-N-acetylglucosaminyltransferase-like 1
  ENST ID: ENST00000576599
  CDS Start-End: 752-1504
attctcccgcctcagcttcccgagtagctgggactacaggagcctgccaccacgcctggctaattttttgtatttttagtagagatggggtttcaccatgttagccaggatggtctcaatctcctgaccttgtaatccacccacctcggcctcccaaagtcctttcagtttttttttcactttcaaaaacatgtagaaggcagttcagggaaagctaagacgtaaagaatcttacaagcatgttaagagcctggagaaaaggagtggacaccttttgtttgtcacggcatatgtgcgggtggtgaaggggaggtaaattagagccatggaaagggaactaagttttcacacttctgttaatccatttcttttgaattccagtctattatcctcccagtccacaacgctgaaccgtggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcggatgacgtcatgatgccccagcgggtgaggctgcaacacgaggctgccgttcagcacccgtcgagcggacgctgctttcctgagctgaatggagcaggttcagacgggcggcctgcggacaggcagcggtttcctcacatccactttgcatgtgattcaagaaatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaa

SEQ ID NO: 198017 - DNA, 1383 bp, Homo sapiens
  Payload ID: 19064
  Gene Name: UDP-GlcNAc:betaGal beta-1,3-N-acetylglucosaminyltransferase-like 1
  Uniprot ID: Q67FW5
  ENST ID: ENST00000621596
  CDS Start-End: 15-1100
gccgaagcggcgggatgagcggagccggcgtgggcggggcgtccgaggagagccaggccatgcaggcccacgtgtctattatcctcccagtccacaacgctgaaccatggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcgtacctttgctttttggattcggatgacgtcatgatgccccagcgggtgaggctgcaacacgaggctgccgttcagcacccgtcgagcatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcatgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaa

SEQ ID NO: 198018 - DNA, 459 bp, Homo sapiens
  Payload ID: 19064
  Gene Name: UDP-GlcNAc:betaGal beta-1,3-N-acetylglucosaminyltransferase-like 1
  ENST ID: ENST00000632715
  CDS Start-End: 14-175
ccgaagcggcgggatgagcggagccggcgtgggcggggcgtccgaggagagccaggccatgcaggcccacgtgtctattatcctcccagtccacaacgctgaaccatggctggacgaatgtttgaggtctgttttgcaacaggactttgaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcgtacctttgctttttggattcgggttcccagggtggagagcctctgccaccctcctgtcccccgactcccgtcttcactggggaaccggccgcatggctgtccacgtgcacaggaagccacatggccttcccggaaccgccccgaggcctctgaactggggcct

SEQ ID NO: 198019 - DNA, 2446 bp, Homo sapiens
  Payload ID: 19064
  Gene Name: UDP-GlcNAc:betaGal beta-1,3-N-acetylglucosaminyltransferase-like 1
  ENST ID: ENST00000632023
  CDS Start-End: 1135-1686
agtgctggcgagaggcagagaagctggatcctcatgcatcactgagggtgagagacggcgcaaccactctggagactgtttggaagttcctgtaaaaactaaacatgtaactgttctgtgacccggcagttgctctcctgggcatttatcccagtggattgaagacgctgttcacagacaaacctgaacttgaatgttcgggatcgccagcacaggacctgactactgttacatgcagtgactggaagcctgtcctgggagccgaggagcagtgcgaaagccgggcacagaaggccgcctcctgcacgttcccggatcatgctctggagagcacagccacggcgtcgggatagcacagccacggcgtcgggatagcacagcggctgccgttgaggggctgccagtggctgtaaggggcgcctcgggtgctcgtgccctgggacatctggatctggactccatcatgtccctctcctggtgcggcgttgaccttgggtcctcgtgatgttaccaccagaggaagtggtgaagggcacagagggtctctctacagttgtttcttacagctgcaatgtgaattcacaattttctcaaagtaagtttaattaaaaaacaacaacaacaacaaatgcaaacagaagcctcccccaagcacgtcattaactgcattggtagaaaagaatcactcactacgcgtaaacgctacacaagttggagacagatccaggggcctcagatgcctcggtgtgacttcatcgcttccgagttaggagactggctcactgataccactctttggaccacagttacattttcactattgtctccttgttggtcttgggtgagacggaatcagctgcgtccgctgggacttgtgacctggggcctgtgctgtgagaacgtctactcgggaggctctgctggccctgggccctcacttggggtgggtgctgtttcctacggacgcgcccaggtgccctctctccagccagctcctcccactgcaagatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcatgtgtgccgaccacaggagccaagccttttccactgtgtggactcatgtggccaaggctaggcctggtcacccaggaccctcaccacgtgaccccagccaatcgggacagttcaaggaggaggagacccctattacacagtgaaggcagaggcgtccaccccaagtcaccagagcgcaggtgcagagaggaaaagctgtcagctagtgccagcctccaagggccagcgctacccttcaacagctggaggcaccactgtgcgaggctttccacaccggcctccctcaggaacaagacatcctcaccaggcaggggtgaggtatgggctccaggactggcttcagcaggcaccaggctgaagaagagacaagacaagctcaggctggtcagctccaacacacaccattcccagccaggggaccctcacccctctgggccctgtgtggggactgacacggttcctgcaggaaaccatttgtgccgtttcccacacacccggcagcctgagctatgtggctgacaggtgctcatgactaacgtgtcctcggaagggcaccccatctggggagcgggaagggaggttcactgcactgctcttaacctgcattcacacgtttgaaatttttcctaataaaaatgtaaaaagcac

SEQ ID NO: 198020 - DNA, 1787 bp, Homo sapiens
  Payload ID: 19064
  Gene Name: UDP-GlcNAc:betaGal beta-1,3-N-acetylglucosaminyltransferase-like 1
  ENST ID: ENST00000633139
  CDS Start-End: 752-1504
attctcccgcctcagcttcccgagtagctgggactacaggagcctgccaccacgcctggctaattttttgtatttttagtagagatggggtttcaccatgttagccaggatggtctcaatctcctgaccttgtaatccacccacctcggcctcccaaagtcctttcagtttttttttcactttcaaaaacatgtagaaggcagttcagggaaagctaagacgtaaagaatcttacaagcatgttaagagcctggagaaaaggagtggacaccttttgtttgtcacggcatatgtgcgggtggtgaaggggaggtaaattagagccatggaaagggaactaagttttcacacttctgttaatccatttcttttgaattccagtctattatcctcccagtccacaacgctgaaccatggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcgtacctttgctttttggattcggatgacgtcatgatgccccagcgggtgaggctgcaacacgaggctgccgttcagcacccgtcgagcggacgctgctttcctgagctgaatggagcaggttcagacgggcggcctgcggacaggcagcggtttcctcacatccactttgcatgtgattcaagaaatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcatgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaa

SEQ ID NO: 198021 - DNA, 3216 bp, Homo sapiens
  Payload ID: 19065
  Gene Name: UDP-glucose 6-dehydrogenase
  Uniprot ID: O60701
  ENST ID: ENST00000316423
  CDS Start-End: 344-1828
agtctccccgcccctgagccgtgaaggaaatagggacctggccctgggccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaacta

SEQ ID NO: 198022 - DNA, 3021 bp, Homo sapiens
  Payload ID: 19065
  Gene Name: UDP-glucose 6-dehydrogenase
  Uniprot ID: O60701
  ENST ID: ENST00000506179
  CDS Start-End: 182-1666
atacagagcagtagctgtctatcgacagacctcaaagacacagtgagcctttgagtttcttcaaatcccttaagaaatggagaacagtagtctttcttcaggggggttctggaaatgaaagagctgactgtctgctctgagatgtgcttattagtggccaggatccagtttaagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaa

SEQ ID NO: 198023 - DNA, 861 bp, Homo sapiens
  Payload ID: 19065
  Gene Name: UDP-glucose 6-dehydrogenase
  ENST ID: ENST00000515021
  CDS Start-End: 318-861
gtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggggcgggaaccgcattttggaactgctgtcctggggatgtggtcgtctgggcttcttattcaagactctacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagcca

SEQ ID NO: 198024 - DNA, 433 bp, Homo sapiens
  Payload ID: 19065
  Gene Name: UDP-glucose 6-dehydrogenase
  ENST ID: ENST00000505698
  CDS Start-End: 180-433
cgcacagacatcccaaatcccggattgggcctgaggaacatctctgcaaagagcgccaggagggcgtgggggtcccgcctctctcgccagggaccagggagtggacactcactggtccagtcatgaggaactcagcatcctcctgacgggaggcgcctctttcccagaagcgtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgt

SEQ ID NO: 198025 - DNA, 577 bp, Homo sapiens
  Payload ID: 19065
  Gene Name: UDP-glucose 6-dehydrogenase
  ENST ID: ENST00000509391
  CDS Start-End: 188-577
gtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggaacagtcttactgttttccttctagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagc

SEQ ID NO: 198026 - DNA, 2826 bp, Homo sapiens
  Payload ID: 19065
  Gene Name: UDP-glucose 6-dehydrogenase
  Uniprot ID: O60701
  ENST ID: ENST00000501493
  CDS Start-End: 163-1446
gtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatc

SEQ ID NO: 198027 - DNA, 549 bp, Homo sapiens
  Payload ID: 19065
  Gene Name: UDP-glucose 6-dehydrogenase
  ENST ID: ENST00000510881
  CDS Start-End: 125-292
gccctaaagcctggcagacgcggagcgcacgcggcctttgcctcggccaggacagggcagcggggagagggctgctagacaacaattcttgacccctcctcgacccacgaccgccagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcata

SEQ ID NO: 198028 - DNA, 575 bp, Homo sapiens
  Payload ID: 19065
  Gene Name: UDP-glucose 6-dehydrogenase
  ENST ID: ENST00000503779
  CDS Start-End: 163-330
gtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagt

SEQ ID NO: 198029 - DNA, 568 bp, Homo sapiens
  Payload ID: 19065
  Gene Name: UDP-glucose 6-dehydrogenase
  ENST ID: ENST00000514106
  CDS Start-End: 110-568
agacgcggagcgcacgcggcctttgcctcggccaggacagggcagcggggagagggctgctagacaacaattcttgacccctcctcgacccacgaccgccagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaat

SEQ ID NO: 198030 - DNA, 1712 bp, Homo sapiens
  Payload ID: 19065
  Gene Name: UDP-glucose 6-dehydrogenase
  Uniprot ID: O60701
  ENST ID: ENST00000507089
  CDS Start-End: 287-1480
gtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctggga

SEQ ID NO: 198031 - DNA, 534 bp, Homo sapiens
  Payload ID: 19065
  Gene Name: UDP-glucose 6-dehydrogenase
  ENST ID: ENST00000510490
  CDS Start-End: 374-534
gtgaaggaaatagggacctggccctgggccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtgggtaagcgccgctcccaggctggccccgccgcccgggcgggatgctcccagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatga

SEQ ID NO: 198032 - DNA, 4007 bp, Homo sapiens
  Payload ID: 19066
  Gene Name: UDP-glucose ceramide glucosyltransferase
  Uniprot ID: Q16739
  ENST ID: ENST00000374279
  CDS Start-End: 451-1635
gggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcgggaccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgttttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttctttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 198033 - DNA, 10650 bp, Homo sapiens
  Payload ID: 19067
  Gene Name: UDP-glucose glycoprotein glucosyltransferase 1
  Uniprot ID: Q9NYU2
  ENST ID: ENST00000259253
  CDS Start-End: 48-4715
ccctggcgttgtctctggcactgtggcggactgaccacggcccgggcatgggctgcaagggagacgcgagcggtgcgtgtgccgcgggtgcgctgccggtgacaggagtttgctataaaatgggagttctggttgtactcactgttctgtggctgttctcctcagtaaaggccgactcaaaagccattacaacctctcttacaacaaaatggttttccactccattgttgttagaagccagtgagtttttagcagaagacagtcaagagaaattttggaattttgtagaagccagtcaaaatattggatcatcagatcatgacggtaccgattattcctactatcatgcaatattggaggctgcatttcagtttctgtcacccctccagcagaatttgtttaaattttgtctgtcccttcgttcttactcagctacaatccaagccttccagcagatagcagctgatgaacctccaccagaaggatgtaattcgtttttttcagtgcatggaaagaagacttgtgaatctgatacccttgaggctcttctactgacagcctctgaaagacccaaacctttattgttcaaaggagatcacagatatccctcgtctaatcctgaaagccctgtggtgattttctactctgagattggctctgaggaattttccaattttcaccgccagcttatatcaaaaagcaatgcaggcaaaatcaattatgtattcagacattatatatttaatcccaggaaggagcctgtttacctctctggctatggcgtggaattggccattaagagcactgagtacaaggccaaggatgatactcaggtgaaaggaactgaggtaaacaccacagtgattggtgaaaatgatcctattgatgaggttcaggggttcctctttggaaaattaagagatctgcaccccgacctggagggacagttgaaagaactcagaaagcatcttgtagagagcaccaatgaaatggcacctttaaaggtttggcagttgcaagatctcagtttccagactgctgctcgaatcttggcttctcctgttgagttggctttggttgtcatgaaggatcttagtcagaattttcctaccaaagccagagcaataacaaaaacagctgtgagctcagaacttagaaccgaagtggaagagaatcagaagtatttcaagggaactttaggattacaacctggagattcagccctcttcatcaatggacttcacatggatttagatacacaggatatattcagtctgtttgatgtgttgaggaatgaagctcgggtaatggagggtctgcatagattgggaatagaaggcctttctctgcataatgttttgaagctgaacatccagccctctgaggcagactatgccgtagacatccggagtcctgctatttcatgggtcaacaacctggaggttgatagcagatataattcgtggccttctagtttacaagagttgcttcgacccacctttcctggtgttattcggcagatcaggaaaaacttacataatatggttttcatagttgatcctgcacatgagaccacagcagagttgatgaacacagctgagatgttccttagtaatcatataccactaagaattggttttatctttgtggttaatgactctgaagatgttgatgggatgcaagatgctggagtggctgttcttagagcatataattatgttgcccaagaagtggatgattatcatgccttccagactctgacacatatctataacaaggtgaggactggagaaaaagtgaaagttgaacatgtggtcagtgtcctggagaagaaatatccgtatgtagaagtgaatagcattttggggattgattctgcttatgatcggaatcggaaggaagcaagaggctactatgagcagactggagttggacctctgcccgttgtgctgttcaatggaatgccctttgaaagggaacagctagaccctgatgagttagaaaccatcacaatgcataaaatcctggagaccaccaccttcttccaaagagcggtgtacttgggtgaactgccccatgatcaagatgtggtagagtatatcatgaatcagccaaatgttgttccacgaatcaattctaggattttgacagctgaacgagactacctggatttaacagcgagtaataacttctttgtggatgattatgctagatttactatcttggattcccaaggcaagactgctgctgtagccaatagtatgaactatctgacaaagaaaggaatgtcctccaaggaaatctatgatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcactgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagtttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcctgagcctgtttttatgttctgtgtacagtggcatttgattgagatcaaagcctgtcacagcctgctgctgggggtgtggggatatgccagagtcctgtgtttggttttagaagtttactgaatgtttcccacatggagaataatggatggcatgttagtttctttaagagtggtaaagttgtacatctgtcattgttgcatttcgaattgaacacatagatgcttgcctgtctgcttgggtgaatgcctcttgggagagcgaagattacgtgcatgatgtatgttaagaaacagtttccggtcaggcacagtggcttacacctgtaatcccagcactttgggaagccgaggcgggcggattatgaggtcaagagatagagaccatcctggccaacacggtgaaaccccgtctctactaaaaatacaaaaattagctgggcatggtggcacacacctgtagtcccagctactcgggaggctgaggcaggagaatcacttgaacccgggaggtggaggttgcagtgagccgagatcatgccactgcactccagcctggcaatagagcgagactccgtctcaaaaaaaaaaaaaaaaaaaaaaaaaaaattaaaacagtttccataaatggagcttaatttgctctgctgtccttaagccctcgtgggtttttttttaagagagtctcattctgtcacccaggctggagtgcagtggtgcgatcttggctcacttcaacctctgcctcccaagttcaaacaattctcctgcctcagcctcctgagtagctgggattacaggcgcctgccaccatgcctggttaatttttgtatttttagtagagatggggttttaccatgttggttggccaggctgatctcaaactcctgacctcaggtggtgatctgcccacctcggcctcccaaagtgctgggattacaggcgtgagccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctggagtggagtgcagtggcacaatctcagctcactgcagcctctgcctcccgggttcaagagattctcctgactcaacctcctgagtagctgggattacaggtgcctgccactatgcctagctaatttttgtatttttagtagagacggggttttgccatgttggccagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttctttaaaa

SEQ ID NO: 198034 - DNA, 6682 bp, Homo sapiens
  Payload ID: 19067
  Gene Name: UDP-glucose glycoprotein glucosyltransferase 1
  ENST ID: ENST00000376723
  CDS Start-End: 148-288
tgctttgcgaggctgggtgttgagtcgagccgcgggaaaggcgcgtgtcggcctctcactggcgcagcctgcactgccgctgccgcctcgccccgccctgccctggcgttgtctctggcactgtggcggactgaccacggcccgggcatgggctgcaagggagacgcgagcggtgcgtgtgccgcgggtgcgctgccggtgacaggtacccaggggtggcgtgaggaggcctcgtggacaaagagagggtttggggcacaaggcgaccctgtgcccctgtcacattgagcttccgcctctaccgtgactcagtttaccctctggtgtcctatcccttcccctattcgcgagcgccccgagttgccctcagtggtcttcttggcaaggagtttgctataaaatgggagttctggttgtactcactgttctgtggctgttctcctcagtaaaggccgactcaaaagccattacaacctctcttacaacaaaatggttttccactccattgttgttagaagccagtgagtttttagcagaagacagtcaagagaaattttggaattttgtagaagccagtcaaaatattggatcatcagatcatgacggtaccgattattcctactatcatgcaatattggaggctgcatttcagtttctgtcacccctccagcagaatttgtttaaattttgtctgtcccttcgttcttactcagctacaatccaagccttccagcagatagcagctgatgaacctccaccagaaggatgtaattcgtttttttcagtgcatggaaagaagacttgtgaatctgatacccttgaggctcttctactgacagcctctgaaagacccaaacctttattgttcaaaggagatcacagatatccctcgtctaatcctgaaagccctgtggtgattttctactctgagattggctctgaggaattttccaattttcaccgccagcttatatcaaaaagcaatgcaggcaaaatcaattatgtattcagacattatatatttaatcccaggaaggagcctgtttacctctctggctatggcgtggaattggccattaagagcactgagtacaaggccaaggatgatactcaggtgaaaggaactgaggtaaacaccacagtgattggtgaaaatgatcctattgatgaggttcaggggttcctctttggaaaattaagagatctgcaccccgacctggagggacagttgaaagaactcagaaagcatcttgtagagagcaccaatgaaatggcacctttaaaggtttggcagttgcaagatctcagtttccagactgctgctcgaatcttggcttctcctgttgagttggctttggttgtcatgaaggatcttagtcagaattttcctaccaaagccagagcaataacaaaaacagctgtgagctcagaacttagaaccgaagtggaagagaatcagaagtatttcaagggaactttaggattacaacctggagattcagccctcttcatcaatggacttcacatggatttagatacacaggatatattcagtctgtttgatgtgttgaggaatgaagctcgggtaatggagggtctgcatagattgggaatagaaggcctttctctgcataatgttttgaagctgaacatccagccctctgaggcagactatgccgtagacatccggagtcctgctatttcatgggtcaacaacctggaggttgatagcagatataattcgtggccttctagtttacaagagttgcttcgacccacctttcctggtgttattcggcagatcaggaaaaacttacataatatggttttcatagttgatcctgcacatgagaccacagcagagttgatgaacacagctgagatgttccttagtaatcatataccactaagaattggttttatctttgtggttaatgactctgaagatgttgatgggatgcaagatgctggagtggctgttcttagagcatataattatgttgcccaagaagtggatgattatcatgccttccagactctgacacatatctataacaaggtgaggactggagaaaaagtgaaagttgaacatgtggtcagtgtcctggagaagaaatatccgtatgtagaagtgaatagcattttggggattgattctgcttatgatcggaatcggaaggaagcaagaggctactatgagcagactggagttggacctctgcccgttgtgctgttcaatggaatgccctttgaaagggaacagctagaccctgatgagttagaaaccatcacaatgcataaaatcctggagaccaccaccttcttccaaagagcggtgtacttgggtgaactgccccatgatcaagatgtggtagagtatatcatgaatcagccaaatgttgttccacgaatcaattctaggattttgacagctgaacgagactacctggatttaacagcgagtaataacttctttgtggatgattatgctagatttactatcttggattcccaaggcaagactgctgctgtagccaatagtatgaactatctgacaaagaaaggaatgtcctccaaggaaatctatgatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcactgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaa

SEQ ID NO: 198035 - DNA, 599 bp, Homo sapiens
  Payload ID: 19067
  Gene Name: UDP-glucose glycoprotein glucosyltransferase 1
  ENST ID: ENST00000418197
  CDS Start-End: 1-394
cataatgatgctatccgtgctgaagaataccaagactcctgtgaaattctggttcttgaagaattacttgtcccccacatttaaggatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctca

SEQ ID NO: 198036 - DNA, 3113 bp, Homo sapiens
  Payload ID: 19067
  Gene Name: UDP-glucose glycoprotein glucosyltransferase 1
  ENST ID: ENST00000438277
  CDS Start-End: 151-315
aattgctttgcgaggctgggtgttgagtcgagccgcgggaaaggcgcgtgtcggcctctcactggcgcagcctgcactgccgctgccgcctcgccccgccctgccctggcgttgtctctggcactgtggcggactgaccacggcccgggcatgggctgcaagggagacgcgagcggagtttgctataaaatgggagttctggttgtactcactgttctgtggctgttctcctcagtaaaggccgactcaaaagccattacaacctctcttacaacaaaatggttttccactccattgttgttagaagccagatagcagctgatgaacctccaccagaaggatgtaattcgtttttttcagtgcatggaaagaagacttgtgaatctgatacccttgaggctcttctactgacagcctctgaaagacccaaacctttattgttcaaaggagatcacagatatccctcgtctaatcctgaaagccctgtggtgattttctactctgagattggctctgaggaattttccaattttcaccgccagcttatatcaaaaagcaatgcaggcaaaatcaattatgtattcagacattatatatttaatcccaggaaggagcctgtttacctctctggctatggcgtggaattggccattaagagcactgagtacaaggccaaggatgatactcaggtgaaaggaactgaggtaaacaccacagtgattggtgaaaatgatcctattgatgaggttcaggggttcctctttggaaaattaagagatctgcaccccgacctggagggacagttgaaagaactcagaaagcatcttgtagagagcaccaatgaaatggcacctttaaaggtttggcagttgcaagatctcagtttccagactgctgctcgaatcttggcttctcctgttgagttggctttggttgtcatgaaggatcttagtcagaattttcctaccaaagccagagcaataacaaaaacagctgtgagctcagaacttagaaccgaagtggaagagaatcagaagtatttcaagggaactttaggattacaacctggagattcagccctcttcatcaatggacttcacatggatttagatacacaggatatattcagtctgtttgatgtgttgaggaatgaagctcgggtaatggagggtctgcatagattgggaatagaaggcctttctctgcataatgttttgaagctgaacatccagccctctgaggcagactatgccgtagacatccggagtcctgctatttcatgggtcaacaacctggaggttgatagcagatataattcgtggccttctagtttacaagagttgcttcgacccacctttcctggtgttattcggcagatcaggaaaaacttacataatatggttttcatagttgatcctgcacatgagaccacagcagagttgatgaacacagctgagatgttccttagtaatcatataccactaagaattggttttatctttgtggttaatgactctgaagatgttgatgggatgcaagatgctggagtggctgttcttagagcatataattatgttgcccaagaagtggatgattatcatgccttccagactctgacacatatctataacaaggtgaggactggagaaaaagtgaaagttgaacatgtggtcagtgtcctggagaagaaatatccgtatgtagaagtgaatagcattttggggattgattctgcttatgatcggaatcggaaggaagcaagaggctactatgagcagactggagttggacctctgcccgttgtgctgttcaatggaatgccctttgaaagggaacagctagaccctgatgagttagaaaccatcacaatgcataaaatcctggagaccaccaccttcttccaaagagcggtgtacttgggtgaactgccccatgatcaagatgtggtagagtatatcatgaatcagccaaatgttgttccacgaatcaattctaggattttgacagctgaacgagactacctggatttaacagcgagtaataacttctttgtggatgattatgctagatttactatcttggattcccaaggcaagactgctgctgtagccaatagtatgaactatctgacaaagaaaggaatgtcctccaaggaaatctatgatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaaggtaaaacatgctatgtaagaaaacagttgaagaaattgtactgaatccaagttctgatattgcatgttagaggatcagatggatttataggtggacatcatgtttg

SEQ ID NO: 198037 - DNA, 586 bp, Homo sapiens
  Payload ID: 19067
  Gene Name: UDP-glucose glycoprotein glucosyltransferase 1
  ENST ID: ENST00000430075
  CDS Start-End: 159-335
agctgggcaattgctttgcgaggctgggtgttgagtcgagccgcgggaaaggcgcgtgtcggcctctcactggcgcagcctgcactgccgctgccgcctcgccccgccctgccctggcgttgtctctggcactgtggcggactgaccacggcccgggcatgggctgcaagggagacgcgagcggagtttgctataaaatgggagttctggttgtactcactgttctgtggctgttctcctcagtaaaggccgactcaaaagccattacaacctctcttacaacaaaatggttttccactccattgttgttagaagccagctgtggagtagagtgagattgtacaccccagtgttcacaagtaatgggaaagtcttcctttggctagtgagtttttagcagaagacagtcaagagaaattttggaattttgtagaagccagtcaaaatattggatcatcagatcatgacggtaccgattattcctactatcatgcaatattggaggctgcatttcagtttctgtcacccctccagcagaatttgtttaaattttgtctgtcccttcgttcttactcagctacaatcc

SEQ ID NO: 198038 - DNA, 2240 bp, Homo sapiens
  Payload ID: 19068
  Gene Name: UDP-glucose glycoprotein glucosyltransferase 2
  ENST ID: ENST00000376712
  CDS Start-End: 82-924
agcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaagcttgtctattgactattgaaaatacgtgttttcaatgagacaccatctcacaccagttagaatgacaatcattaaaaaggaaacgacagatgctggaggggatgtggagaaataggaaggcttttacactgttggtgtgtgtgtagatgagttcaaccgttgtggaagacagtgtggcaattcctcaaggatctagaaccagaaataccatttgacccagcaatgcccattactgggtgtatacccaaaggattataaatcattctactataaagacacatgcacacgtatgttgattgtagcactattcacaatagcaaagacttcgaaccaacccaaatgtccatcaatgatagactggataaagaaaatgtggcacatatacaccatagaatactctgcatccataaaaaaggataagttcatgtcctttgcagggacatggatgaagctggaaactatcattctcagcaaactaacacaggaacagaaaaccaaacaccacatgttcttactcaaaagtgggactcgaacagtgagaacacatggacacagggaggggaatatcacacaccgtggcttgtcgggggtggggagctaggagagggatagcattaggagaaatacctaatgtggataacgggttgatgggtgcagcagaccaccatgacacgtgtatacctgtgtaacaaacctgcacgttctacacatgtatcccagaacttaaagtataataaaatgaaaatatgtattttgtaagttgtgctgatagtaacttttttaaattgtatttctccatttaaatctgaaatggcaccatgtcttgatttcatgagtgatagaggaaagaagattacagtttagattgtgtgtatagtaaaataccattctactacatcattatttggctctctaaaagatgcctagagatgtttaacaatgggtaaaattatcttattttagttttttataagaatcaaagatggaacttttcagaaataaactctgattgtatgaggcatttttgactttccttatagtttttattttcaattataaaagcaaggcttgcaatttataaaatgttaaacaaaaagtatgtaatatgaaaacataagtctgccctcatccttgcatcgcttacagttgacactaacaattgagagtatattcctccagattttgttttgtttcatatatttaataaaagagacctgtatatcttcctcattatttttaagttccgtgaatatagctgtatcacaatttatgattatcttaatgatgaatgattcatttatgtctaattacatggaatatgtaatttc

SEQ ID NO: 198039 - DNA, 1233 bp, Homo sapiens
  Payload ID: 19068
  Gene Name: UDP-glucose glycoprotein glucosyltransferase 2
  Uniprot ID: Q9NYU1
  ENST ID: ENST00000376714
  CDS Start-End: 171-1007
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaagtatattccagaatttcttccgaggtagtatggttttcttcataggataaagaataaaggctgtgagttaatt

SEQ ID NO: 198040 - DNA, 4832 bp, Homo sapiens
  Payload ID: 19068
  Gene Name: UDP-glucose glycoprotein glucosyltransferase 2
  Uniprot ID: Q9NYU1
  ENST ID: ENST00000376747
  CDS Start-End: 72-4622
gccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaa

SEQ ID NO: 198041 - DNA, 1547 bp, Homo sapiens
  Payload ID: 19068
  Gene Name: UDP-glucose glycoprotein glucosyltransferase 2
  ENST ID: ENST00000397618
  CDS Start-End: 89-1207
gccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgcctt

SEQ ID NO: 198042 - DNA, 1945 bp, Homo sapiens
  Payload ID: 19068
  Gene Name: UDP-glucose glycoprotein glucosyltransferase 2
  ENST ID: ENST00000621375
  CDS Start-End: 27-812
gggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaagtgttccaagatccagaggcttttttttaagtcagttttctcaagtcagatgttaacaataaaagtatgggaacatttatcttccattaataagtttgttaaataatatagtgcacttatttttaatgacgttaaattatatagttttatttatacttgtgatttcatatttgttagcattttaatatttctcattaataagtatgttatagaagtagtatttagacatcttgcctattagtttataacaatttataggaagctttacctttttaatgttatttttttctctaaaacaaaactactttctcttgaacatattgtttgattttgtgtgtgtgtttttaggaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttgg

SEQ ID NO: 198043 - DNA, 2338 bp, Homo sapiens
  Payload ID: 19069
  Gene Name: UDP-glucose pyrophosphorylase 2
  Uniprot ID: Q16851
  ENST ID: ENST00000337130
  CDS Start-End: 477-2003
ggttttcgggggaggcgtttggggcctggacggcggcgcggggagggggcagctaggggcgcggcctgccagtgcctcctgcagtacagccctggagggcgtggggacttgggggcggtgaaatagccgctgtaggtccgcctctttcattgaagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaata

SEQ ID NO: 198044 - DNA, 2136 bp, Homo sapiens
  Payload ID: 19069
  Gene Name: UDP-glucose pyrophosphorylase 2
  Uniprot ID: Q16851
  ENST ID: ENST00000394417
  CDS Start-End: 308-1801
ctgtcggtccgtgcggcagggacatttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaata

SEQ ID NO: 198045 - DNA, 1955 bp, Homo sapiens
  Payload ID: 19069
  Gene Name: UDP-glucose pyrophosphorylase 2
  ENST ID: ENST00000445915
  CDS Start-End: 68-1621
cttttcgttgaattgtcatctgagctgccttgagctgctgggttgacgttccagacgcgtataatttatgctcctgtaccctgctgggtttagttttgcctccctgaaatcagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaat

SEQ ID NO: 198046 - DNA, 505 bp, Homo sapiens
  Payload ID: 19069
  Gene Name: UDP-glucose pyrophosphorylase 2
  ENST ID: ENST00000480679
  CDS Start-End: 392-505
agggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaaggtacctgtgcgtgcacgcagacgggaagggctggggaagcgggaggactgagaaaagccgggatctgcctctgtcacccaggctggagtgcggtggcgcgatctcgcctcactgcagcctctgcctcctcggctcaagatcttagcaaagcaatgtctcaagatggtgcttctcagttccaagaagtcattcggcaagagctagaattatctgtgaagaaggaactagaaaaaatactcaccacagcatcatcacatgaatttgag

SEQ ID NO: 198047 - DNA, 889 bp, Homo sapiens
  Payload ID: 19069
  Gene Name: UDP-glucose pyrophosphorylase 2
  ENST ID: ENST00000487042
  CDS Start-End: 46-204
agtagtaccgtcgctttcctggatagtggctatcttagcaaagcaatgtctcaagatggtgcttctcagttccaagaagtcattcggcaagagctagaattatctgtgaagaaggaactagaaaaaatactcaccacagcatcatcacatgaatttgagacaccgggttttgccatattgccgaggctggtctcaaactcctgagctcaaacgatcagctggcctgagcctcccaaagtgctgggattacaggcatgcaccaactacgcccagcctgtattagcttttaggatgtgaaaaagtcttgctccctccatgtcctaatggtcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgctt

SEQ ID NO: 198048 - DNA, 598 bp, Homo sapiens
  Payload ID: 19069
  Gene Name: UDP-glucose pyrophosphorylase 2
  ENST ID: ENST00000483108
  CDS Start-End: 244-390
gaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagagagtcacttctgatagaaccatgctactttgacaattgtcatagaagttttccagaactgggaggcatttacttttttacttgtaaatcaatagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcc

SEQ ID NO: 198049 - DNA, 722 bp, Homo sapiens
  Payload ID: 19069
  Gene Name: UDP-glucose pyrophosphorylase 2
  ENST ID: ENST00000497510
  CDS Start-End: 277-507
attgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcggcaggctaacaagaagggagatacaagatgattttagtaaagagtcctttactaaggactttactggaacagattgtgacgtaagcagattcaaccctatgaaaagataaaggccaggggcttgcctgataatatatcttccgtgttgaacaaactagtggtggtgaaactcaatggtggtttgggaaccagcatgggctgcaaaggccctaaaagtctgattg

SEQ ID NO: 198050 - DNA, 864 bp, Homo sapiens
  Payload ID: 19069
  Gene Name: UDP-glucose pyrophosphorylase 2
  ENST ID: ENST00000493222
  CDS Start-End: 238-384
tttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagagagtcacttctgatagaaccatgctactttgacaattgtcatagaagttttccagaactgggaggcatttacttttttacttgtaaatcaatagacaccgggttttgccatattgccgaggctggtctcaaactcctgagctcaaacgatcagctggcctgagcctcccaaagtgctgggattacaggcatgcaccaactacgcccagcctgtattagcttttaggatgtgaaaaagtcttgctccctccatgtcctaatggtcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtg

SEQ ID NO: 198051 - DNA, 553 bp, Homo sapiens
  Payload ID: 19069
  Gene Name: UDP-glucose pyrophosphorylase 2
  ENST ID: ENST00000484142
  CDS Start-End: 407-553
ggcagggacatttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgag

SEQ ID NO: 198052 - DNA, 1023 bp, Homo sapiens
  Payload ID: 19069
  Gene Name: UDP-glucose pyrophosphorylase 2
  ENST ID: ENST00000466642
  CDS Start-End: 296-454
gcggcagggacatttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagacaccgggttttgccatattgccgaggctggtctcaaactcctgagctcaaacgatcagctggcctgagcctcccaaagtgctgggattacaggcatgcaccaactacgcccagcctgtattagcttttaggatgtgaaaaagtcttgctccctccatgtcctaatggtcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacaatgagtaaaaaa

SEQ ID NO: 198053 - DNA, 747 bp, Homo sapiens
  Payload ID: 19069
  Gene Name: UDP-glucose pyrophosphorylase 2
  ENST ID: ENST00000467999
  CDS Start-End: 1-90
agttttgcctccctgaaatcaggtacctgtgcgtgcacgcagacgggaagggctggggaagcgggaggactgagaaaagccggatcttagcaaagcaatgtctcaagatggtgcttctcagttccaagaagtcattcggcaagagctagaattatctgtgaagaaggaactagaaaaaatactcaccacagcatcatcacatgaatttgagacaccgggttttgccatattgccgaggctggtctcaaactcctgagctcaaacgatcagctggcctgagcctcccaaagtgctgggattacaggcatgcaccaactacgcccagcctgtattagcttttaggatgtgaaaaagtcttgctccctccatgtcctaatggtcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagatacca

SEQ ID NO: 198054 - DNA, 717 bp, Homo sapiens
  Payload ID: 19069
  Gene Name: UDP-glucose pyrophosphorylase 2
  ENST ID: ENST00000467400
  CDS Start-End: 266-496
gccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaaggtacctgtgcgtgcacgcagacgggaagggctggggaagcgggaggactgagaaaagccggatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcggcaggctaacaagaagggagatacaagatgattttagtaaagagtcctttactaaggactttactggaacagattgtgacgtaagcagattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtga

SEQ ID NO: 198055 - DNA, 558 bp, Homo sapiens
  Payload ID: 19069
  Gene Name: UDP-glucose pyrophosphorylase 2
  ENST ID: ENST00000472047
  CDS Start-End: 107-558
atttctcgagtttgatcctgtgtctgggattttttcaagtctgcctctgaaacttagacctgtgttgacagagagcacatgcaatattaaatatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaat

SEQ ID NO: 198056 - DNA, 560 bp, Homo sapiens
  Payload ID: 19069
  Gene Name: UDP-glucose pyrophosphorylase 2
  ENST ID: ENST00000475462
  CDS Start-End: 49-560
gttagtagtaccgtcgctttcctggatagtggctatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcg

SEQ ID NO: 198057 - DNA, 784 bp, Homo sapiens
  Payload ID: 19069
  Gene Name: UDP-glucose pyrophosphorylase 2
  ENST ID: ENST00000488245
  CDS Start-End: 379-784
ctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaaggtacctgtgcgtgcacgcagacgggaagggctggggaagcgggaggactgagaaaagccggatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattg

SEQ ID NO: 198058 - DNA, 645 bp, Homo sapiens
  Payload ID: 19069
  Gene Name: UDP-glucose pyrophosphorylase 2
  ENST ID: ENST00000482668
  CDS Start-End: 332-645
gcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagtctgcctctgaaacttagacctgtgttgacagagagcacatgcaatattaaatatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtgg

SEQ ID NO: 198059 - DNA, 566 bp, Homo sapiens
  Payload ID: 19069
  Gene Name: UDP-glucose pyrophosphorylase 2
  ENST ID: ENST00000487640
  CDS Start-End: 116-274
agagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagacaccgggttttgccatattgccgaggctggtctcaaactcctgagctcaaacgatcagctggcctgagcctcccaaagtgctgggattacaggcatgcaccaactacgcccagcctgtattagcttttaggatgtgaaaaagtcttgctccctccatgtcctaatggtcacaccaaaaaagacctggatggatttcggaagctatttcatagatttttgcaagaaaaggggccttctgtggattggggaaaaatccagagaccccctgaagattcggcaggctaacaagaagggagatacaagatgattttagtaaagagtcctttactaaggact

SEQ ID NO: 198060 - DNA, 605 bp, Homo sapiens
  Payload ID: 19069
  Gene Name: UDP-glucose pyrophosphorylase 2
  ENST ID: ENST00000497883
  CDS Start-End: 81-605
gaggaagagagacctgccctgtagcgtgactcctctagaaaaaaaaaaaaaaagccggagtattttactaagcccctaaaatgtcgagatttgtacaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtg

SEQ ID NO: 198061 - DNA, 753 bp, Homo sapiens
  Payload ID: 19069
  Gene Name: UDP-glucose pyrophosphorylase 2
  ENST ID: ENST00000491621
  CDS Start-End: 116-753
gctattctgctgttgggtcaccttctgcctacttgtgacattccttctgctcttccttgctccagggattgttccagggcccccagttattctaaatggatatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatgg

SEQ ID NO: 198062 - DNA, 565 bp, Homo sapiens
  Payload ID: 19069
  Gene Name: UDP-glucose pyrophosphorylase 2
  ENST ID: ENST00000496334
  CDS Start-End: 12-125
gcgtataatttatgctcctgtaccctgctgggtttagttttgcctccctgaaatcaggtacctgtgcgtgcacgcagacgggaagggctggggaagcgggaggactgagaaaagccggatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacag

SEQ ID NO: 198063 - DNA, 2057 bp, Homo sapiens
  Payload ID: 19069
  Gene Name: UDP-glucose pyrophosphorylase 2
  Uniprot ID: Q16851
  ENST ID: ENST00000467648
  CDS Start-End: 340-1833
gcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaaggtacctgtgcgtgcacgcagacgggaagggctggggaagcgggaggactgagaaaagccggatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgc

SEQ ID NO: 198064 - DNA, 1858 bp, Homo sapiens
  Payload ID: 19069
  Gene Name: UDP-glucose pyrophosphorylase 2
  ENST ID: ENST00000613823
  CDS Start-End: 1-1527
atgagaatttttgtagaggatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagc

SEQ ID NO: 198065 - DNA, 264 bp, Homo sapiens
  Payload ID: 19069
  Gene Name: UDP-glucose pyrophosphorylase 2
  ENST ID: ENST00000627474
  CDS Start-End: 118-264
aggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagagagtcacttctgatagaaccatgctactttga

SEQ ID NO: 198066 - DNA, 276 bp, Homo sapiens
  Payload ID: 19069
  Gene Name: UDP-glucose pyrophosphorylase 2
  ENST ID: ENST00000626380
  CDS Start-End: 118-276
aggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagacaccgggttttgccatattgccgaggctggtctcaaactcctga

SEQ ID NO: 198067 - DNA, 2099 bp, Homo sapiens
  Payload ID: 19070
  Gene Name: UDP-glucuronate decarboxylase 1
  Uniprot ID: Q8NBZ7
  ENST ID: ENST00000283148
  CDS Start-End: 99-1376
ggcggggctctcggggccgctgccgccgccgccgccgcgcattgtgcagcaggcgggcccccgcgcggtagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgagctttctactcaacaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaattattgaaactcaccagtcatgga

SEQ ID NO: 198068 - DNA, 1839 bp, Homo sapiens
  Payload ID: 19070
  Gene Name: UDP-glucuronate decarboxylase 1
  Uniprot ID: Q8NBZ7
  ENST ID: ENST00000409501
  CDS Start-End: 59-1321
attgtgcagcaggcgggcccccgcgcggtagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcag

SEQ ID NO: 198069 - DNA, 1935 bp, Homo sapiens
  Payload ID: 19070
  Gene Name: UDP-glucuronate decarboxylase 1
  Uniprot ID: Q8NBZ7
  ENST ID: ENST00000409032
  CDS Start-End: 755-1513
aggataggaactggagttattgttaatgttacaggaagaacacattctcaaaggagaggggggtggtgggaaactttgattttcatagggttttcagtttcctctcaaatgggaggatgcagcagtgccgctacttaactgaacgtctcgacagtctgatggggcggccctcagccttccggagcagcagtgggactgacctgtccagtgaggaagaaacactgaaccagatggaatggcctttggggatggaaaaaccccagtttacgctcatctcttctctcagctaacttttgtggagccctgttcccaaactggcctgggccagagcaccgtggaggggtatttgttgtaaatggaaggtttccaggcccgcctggaaatcctgaagggtgagacctgcagtgggctcaggagtctgcatttgtgggtgaccgagggggcctcccctccctctagagtccacactgtggagagcatcaggaagggaaaggcctgcatcttgtgctcagtgagctcatcgtctagtgaggaaggcatgtgtgaatctctggacaaggcagcgctgagctgttgtggactagtggtgcaggcaagggattatttctgaccaaggatggtgagaaggtttcccatacagactgacgtctggattgagctttgaagaagaaagccaggactggagcagacgacgaggagggaagagtttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaa

SEQ ID NO: 198070 - DNA, 502 bp, Homo sapiens
  Payload ID: 19070
  Gene Name: UDP-glucuronate decarboxylase 1
  ENST ID: ENST00000436241
  CDS Start-End: 345-502
agtttcctctcaaatgggaggatgcagcagtgccgctacttaactgaacgtctcgacagtctgatggggcggccctcagccttccggagcagcagtgggactgacctgtccagtgaggaagaaacactgaaccagatggaatggcctttggggatggaaaaaccccagtttacgctcatctcttctctcagctaacttttgtggagccctgttcccaaactggcctgggccagagcaccgtggaggggtatttgttgtaaatggaaggtttccaggcccgcctggaaatcctgaaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggcca

SEQ ID NO: 198071 - DNA, 682 bp, Homo sapiens
  Payload ID: 19070
  Gene Name: UDP-glucuronate decarboxylase 1
  ENST ID: ENST00000457835
  CDS Start-End: 111-682
attgtgcagcaggcgggcccccgcgcggtagggccctggacccgcgcggctcccggggatggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagca

SEQ ID NO: 198072 - DNA, 701 bp, Homo sapiens
  Payload ID: 19070
  Gene Name: UDP-glucuronate decarboxylase 1
  ENST ID: ENST00000416298
  CDS Start-End: 298-701
ttctaagctgacagcttggattaacatttgtttccatggccccggatgcacactccacagtcctgcgcctccgctcctcactgaattggttttctccctgcaccgcgttttcccatatgtagctatattcccattcccgagcggtcttgactctaaaatcatatacacggtagagaaggagccctgaagctttacccagaaatacccaccagtaaagtttttatcagaaaaggatcggaaaagaattttgttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcag

SEQ ID NO: 198073 - DNA, 800 bp, Homo sapiens
  Payload ID: 19070
  Gene Name: UDP-glucuronate decarboxylase 1
  ENST ID: ENST00000444193
  CDS Start-End: 438-800
ccggatgcacactccacagtcctgcgcctccgctcctcactgaattggttttctccctgcaccgcgttttcccatatgtagctatattcccattcccgagcggtcttgactctaaaatcatatacacggtagagaaggagccctgaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggta

SEQ ID NO: 198074 - DNA, 570 bp, Homo sapiens
  Payload ID: 19070
  Gene Name: UDP-glucuronate decarboxylase 1
  ENST ID: ENST00000441952
  CDS Start-End: 59-570
attgtgcagcaggcgggcccccgcgcggtagggccctggacccgcgcggctcccggggatggtgagcaaggcgctgctgcgcctcgtgtctgccgtcaaccgcaggaggatgaagctgctgctgggcatcgccttgctggcctacgtcgcctggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggtgagtgctcc

SEQ ID NO: 198075 - DNA, 2377 bp, Homo sapiens
  Payload ID: 19071
  Gene Name: UDP-N-acetylglucosamine pyrophosphorylase 1
  Uniprot ID: Q16222
  ENST ID: ENST00000271469
  CDS Start-End: 330-1898
cggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctggagtgtc

SEQ ID NO: 198076 - DNA, 2066 bp, Homo sapiens
  Payload ID: 19071
  Gene Name: UDP-N-acetylglucosamine pyrophosphorylase 1
  Uniprot ID: Q16222
  ENST ID: ENST00000367924
  CDS Start-End: 33-1598
ctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtc

SEQ ID NO: 198077 - DNA, 2069 bp, Homo sapiens
  Payload ID: 19071
  Gene Name: UDP-N-acetylglucosamine pyrophosphorylase 1
  Uniprot ID: Q16222
  ENST ID: ENST00000367925
  CDS Start-End: 33-1601
ctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtc

SEQ ID NO: 198078 - DNA, 2294 bp, Homo sapiens
  Payload ID: 19071
  Gene Name: UDP-N-acetylglucosamine pyrophosphorylase 1
  Uniprot ID: Q16222
  ENST ID: ENST00000367926
  CDS Start-End: 303-1820
ctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 198079 - DNA, 3201 bp, Homo sapiens
  Payload ID: 19072
  Gene Name: UDP-N-acetylglucosamine pyrophosphorylase 1 like 1
  Uniprot ID: Q3KQV9
  ENST ID: ENST00000360271
  CDS Start-End: 237-1391
gtaccgtgtggggctgcccagccggaagaccctgtaccagctgcaggcggagcggattcggcgggtggagcagctggccggtgagcgccacgggacccgctgcaccgtcccctggtgtgtcctgcctgccctacctcggcccggaggtacccttccccacgcccccccacatccccgctccagacgcgagccccaaccccggcacagaccgggacattgcccagaaccggcccaaaatggggcctggccccagccccaactggacactggaccccgaaccccgatgccggctctggtccgagccccgtctgcctgcagggccaggcgtactcgcggccggctcaccgcgcctcccttgcaggtacgtcatgaccagcgagttcactctggggcccacggccgagttcttcagggagcacaacttcttccacctggaccccgccaacgtggtcatgtttgagcagcgcctgctgcctgctgtgacctttgatggcaaggttatcctggagcggaaagacaaagttgccatggccccagacggcaacgggggcctctactgcgcgctggaggaccacaagatcctggaggacatggagcgccggggagtggagtttgtgcacgtgtactgtgtggacaacatcctggtgcggctggcggaccctgtcttcatcggcttctgtgtgttgcagggcgcagactgtggcgccaaggtggtggaaaaggcataccccgaggagcccgtgggcgtggtgtgccaggtggacggtgtcccccaggtggtggagtacagcgagatcagtcctgagaccgcacagctacgtgcctccgacgggagcctgctgtacaatgcaggcaacatctgcaaccacttcttcacccgaggcttccttaaggcggtcaccagggagtttgagcctttgctgaagccacacgtggctgtgaagaaggtcccgtatgtggatgaggaggggaatctggtaaagccgctaaaaccgaacgggataaagatggagaagtttgtgtttgatgtgttccggtttgctaagaactttgctgccttggaagtgctgcgggaggaggaattttccccactgaagaacgcagagccagccgacagggacagtccccgcaccgctcgccaggccctgctcacccagcactaccggtgggctctgcgggccggggcccgcttcctggatgcccatggggcctggctcccagagctgcccagcttgcccccaaatggagaccctccggccatctgtgagatatcgcccttggtgtcttactctggagagggtttagaagtgtacctgcaaggccgggagttccagtccccgctcatcctggatgaagaccaggccagggagccgcagctgcaggagtcctgacccgcccagactgtccccagactcccccgagacctgccagccccggcatcctggaagtcccgactccccccagacctgccagccccggcgtcctggagctgggggctacagcccagcctgagctctgggtgggaaagcagcctgccccatgcttccagcctgcagaacacagaatgaaacatgctggtagactccacgagggcagggcctctcctgtcgcctctggacacaagtggcgacagcctgctgggggctctgtggctccattcctggctgtggggtctagtcaagaggcagagggacttgggacctgggagaatggggctgagaggaggcttcgggttggggcccaagggaggtgtggtgtcatctggggagaacaggagggcatgtccctttgggagcccgccttgtggatccaccacaccccaccgagcactagaagctgcataagctacacaggatgtgcttctgcagcctacagatgcagaaccagaatgagggggacaattccacccactcgagggctgccccctcttccttagcagacgaaccagtaatgggggcaaggctggggcatcccagcccacacaccctggatgcccagcaaggccacagaaagagcctgatgtccatgatccaggtggctctgagaagcttggcctggacacctgagcctgcggccggtactcctgccttctccccatctatccccaaggcctctgcctctcagcctcttccatggtcggtttaggctgctgagttttctgtgcttccccaagaaccagtgggatcaatgccggcggcctctgtgatggttgctgactaatccgggatttcatgagtcagaggcaccacccctcaccccagctgcctgctgcttctgacggatcttggtgctcaggctgcctggctctccgagtgaggacgcagcctccatatttggtgcactcaggcatggctgggacaagccagctgccccagggttcttcccctggtgattctcgcctgctttctcatctcaggggaggcagtggcacctccctctccctgctgacatgaagagagctatgatatgccactgctgccaactcatcctctgcccccacctcgaaacccacagtccccagtggagggccactactcatccccattggtttcccaggggaggggtgttgtctggaagggcaggttcagatgcagccttccagatttagaggcactgggaggacagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgac

SEQ ID NO: 198080 - DNA, 3365 bp, Homo sapiens
  Payload ID: 19072
  Gene Name: UDP-N-acetylglucosamine pyrophosphorylase 1 like 1
  Uniprot ID: Q3KQV9
  ENST ID: ENST00000409858
  CDS Start-End: 33-1556
cgagtgccgacttgacagacggcagcggcgacatggcttcggagcaggacgtgcgcgcccggctgcagcgcgctggccaggagcacctcctgcgcttctgggccgagctggcgccggagccacgagccgcgctgctggcggagctggcgctgctggagcccgaggcgctgcgcgagcactgccggcgggcggcggaggcctgcgcgcgcccccacggcccgccgcccgacttggccgcgcgcctgcggcccctgcccccagagcgcgtgggcagggccagccgcagcgaccccgagacacggcggcgctgggaggaggaaggtttccgtcagatttctctgaacaaggtggccgtcctgctgctggctggggggcagggcactcgcctgggcgtgacctaccccaagggtatgtaccgtgtggggctgcccagccggaagaccctgtaccagctgcaggcggagcggattcggcgggtggagcagctggccggtgagcgccacgggacccgctgcaccgtcccctggtacgtcatgaccagcgagttcactctggggcccacggccgagttcttcagggagcacaacttcttccacctggaccccgccaacgtggtcatgtttgagcagcgcctgctgcctgctgtgacctttgatggcaaggttatcctggagcggaaagacaaagttgccatggccccagacggcaacgggggcctctactgcgcgctggaggaccacaagatcctggaggacatggagcgccggggagtggagtttgtgcacgtgtactgtgtggacaacatcctggtgcggctggcggaccctgtcttcatcggcttctgtgtgttgcagggcgcagactgtggcgccaaggtggtggaaaaggcataccccgaggagcccgtgggcgtggtgtgccaggtggacggtgtcccccaggtggtggagtacagcgagatcagtcctgagaccgcacagctacgtgcctccgacgggagcctgctgtacaatgcaggcaacatctgcaaccacttcttcacccgaggcttccttaaggcggtcaccagggagtttgagcctttgctgaagccacacgtggctgtgaagaaggtcccgtatgtggatgaggaggggaatctggtaaagccgctaaaaccgaacgggataaagatggagaagtttgtgtttgatgtgttccggtttgctaagaactttgctgccttggaagtgctgcgggaggaggaattttccccactgaagaacgcagagccagccgacagggacagtccccgcaccgctcgccaggccctgctcacccagcactaccggtgggctctgcgggccggggcccgcttcctggatgcccatggggcctggctcccagagctgcccagcttgcccccaaatggagaccctccggccatctgtgagatatcgcccttggtgtcttactctggagagggtttagaagtgtacctgcaaggccgggagttccagtccccgctcatcctggatgaagaccaggccagggagccgcagctgcaggagtcctgacccgcccagactgtccccagactcccccgagacctgccagccccggcatcctggaagtcccgactccccccagacctgccagccccggcgtcctggagctgggggctacagcccagcctgagctctgggtgggaaagcagcctgccccatgcttccagcctgcagaacacagaatgaaacatgctggtagactccacgagggcagggcctctcctgtcgcctctggacacaagtggcgacagcctgctgggggctctgtggctccattcctggctgtggggtctagtcaagaggcagagggacttgggacctgggagaatggggctgagaggaggcttcgggttggggcccaagggaggtgtggtgtcatctggggagaacaggagggcatgtccctttgggagcccgccttgtggatccaccacaccccaccgagcactagaagctgcataagctacacaggatgtgcttctgcagcctacagatgcagaaccagaatgagggggacaattccacccactcgagggctgccccctcttccttagcagacgaaccagtaatgggggcaaggctggggcatcccagcccacacaccctggatgcccagcaaggccacagaaagagcctgatgtccatgatccaggtggctctgagaagcttggcctggacacctgagcctgcggccggtactcctgccttctccccatctatccccaaggcctctgcctctcagcctcttccatggtcggtttaggctgctgagttttctgtgcttccccaagaaccagtgggatcaatgccggcggcctctgtgatggttgctgactaatccgggatttcatgagtcagaggcaccacccctcaccccagctgcctgctgcttctgacggatcttggtgctcaggctgcctggctctccgagtgaggacgcagcctccatatttggtgcactcaggcatggctgggacaagccagctgccccagggttcttcccctggtgattctcgcctgctttctcatctcaggggaggcagtggcacctccctctccctgctgacatgaagagagctatgatatgccactgctgccaactcatcctctgcccccacctcgaaacccacagtccccagtggagggccactactcatccccattggtttcccaggggaggggtgttgtctggaagggcaggttcagatgcagccttccagatttagaggcactgggaggacagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattga

SEQ ID NO: 198081 - DNA, 645 bp, Homo sapiens
  Payload ID: 19072
  Gene Name: UDP-N-acetylglucosamine pyrophosphorylase 1 like 1
  ENST ID: ENST00000476184
  CDS Start-End: 8-307
cggcgacatggcttcggagcaggacgtgcgcgcccggctgcagcgcgctggccaggagcacctcctgcgcttctgggccgagctggcgccggagccacgagccgcgctgctggcggagctggcgctgctggagcccgaggcgctgcgcgagcactgccggcgggcggcggaggcctgcgcgcgcccccacggcccgccgcccgacttggccgcgcgcctgcggcccctgcccccagagcgcgtgggcagggccagccgcagcgaccccgagacacggcggcgctgggaggaggaaggtacgtcatgaccagcgagttcactctggggcccacggccgagttcttcagggagcacaacttcttccacctggaccccgccaacgtggtcatgtttgagcagcgcctgctgcctgctgtgacctttgatggcaaggttatcctggagcggaaagacaaagttgccatggccccagacggcaacgggggcctctactgcgcgctggaggaccacaagatcctggaggacatggagcgccggggagtggagtttgtgcacgtgtactgtgtggacaacatcctggtgcggctggcggaccctgtcttcatcggcttctgtgtgttgcagggcgcagactgtggcgccaag

SEQ ID NO: 198082 - DNA, 995 bp, Homo sapiens
  Payload ID: 19073
  Gene Name: UEV and lactate/malate dehyrogenase domains
  Uniprot ID: Q8IX04
  ENST ID: ENST00000300038
  CDS Start-End: 28-675
gggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaaggtggagtctcgctctgttacccaggctggagtgtagtggtacaatcttggctcactacagcctccgcctcctgggttcaagcgattctcctgcctcagcctccagagtagctgggactacaggcatgcgccacgacgcccagctaatttttgtatttttagcagagacagggttttgccatgttggccaggctggtctcgaacttctgacctcaagtgatccacctgccctggcctcccaaagtgctgggattacaagtgtgagccaccgtacctggcctgctattacctcttaattagaatttgagttgtattcagtcttttgtcactaaataaatgcttctataaacatttcaa

SEQ ID NO: 198083 - DNA, 1799 bp, Homo sapiens
  Payload ID: 19073
  Gene Name: UEV and lactate/malate dehyrogenase domains
  Uniprot ID: Q8IX04
  ENST ID: ENST00000320750
  CDS Start-End: 33-1106
gtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagcttaagttactaatgtttcttgtgtaaaatcctgttggtagtaatagtaaagcattgtatttcccttcttcaaattaattacctaccaaaaaatggaaa

SEQ ID NO: 198084 - DNA, 1848 bp, Homo sapiens
  Payload ID: 19073
  Gene Name: UEV and lactate/malate dehyrogenase domains
  Uniprot ID: Q8IX04
  ENST ID: ENST00000379387
  CDS Start-End: 53-1402
aagaaggtccgggggctggagtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagagccatggaactgctaagagtaaaaggtcaaagatcctggtctgttggactatcagtagctgacatggttgacagtattgtaaacaataagaagaaagtgcattctgtatcagctttagcaaagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagctta

SEQ ID NO: 198085 - DNA, 1354 bp, Homo sapiens
  Payload ID: 19073
  Gene Name: UEV and lactate/malate dehyrogenase domains
  ENST ID: ENST00000396196
  CDS Start-End: 64-261
agcaagtccggaagaaggtccgggggctggagtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcaggcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagagccatggaactgctaagagtaaaaggtcaaagatcctggtctgttggactatcagtagctgacatggttgacagtattgtaaacaataagaagaaagtgcattctgtatcagctttagcaaagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaa

SEQ ID NO: 198086 - DNA, 4156 bp, Homo sapiens
  Payload ID: 19073
  Gene Name: UEV and lactate/malate dehyrogenase domains
  Uniprot ID: Q8IX04
  ENST ID: ENST00000396197
  CDS Start-End: 30-1445
ctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagagccatggaactgctaagagtaaaaggtcaaagatcctggtctgttggactatcagtagctgacatggttgacagtattgtaaacaataagaagaaagtgcattctgtatcagctttagcaaagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagcttaagttactaatgtttcttgtgtaaaatcctgttggtagtaatagtaaagcattgtatttcccttcttcaaattaattacctaccaaaaaatggaaaagaattttacatgcactttaaaatagtaaaatggaaagtgaatttttaaaatatatgcattaaaagtttactttaatttccagtgggacttcctttatgaaattttccataacctcttcctggagtattacaagatctccaacatctcataaactaattgtgatattagtggaaccataagcaaatatatatttttagtggaaatagattatgaatgaaagccaagcaccttactttaaagccaaaatatgagattttcattaaaaacattggtcataatagggagaggttttttatttgttctgagcaaatcctttaacctctcctgatgatacagttcagagtacacacactttggtgatggatcaagagcaatattttcttatgtgaaagatagcttattattactattgtgacatacaactaatagtaacagttaacatcaacacttcatatataccaggcagcatgataagcactttattattttactgaatcctcacaacagaccactgaggtagggactattgccatcatcattttataaaaggaaattgaggtttagtcctcaagaagtcttggctattaaggggcacttatccatacaacctctactttttctaggcactaaaagggggaaaaggcttaatagccaaaatagttatcaaaagaccctaaagctggggtcctgtacaccatgaaaggattactttcattctcatgtaagggcatgcttttataaaaaacaaacatgggctaggcgcagtgactcacgcctgtaatcccagcaccttgggaggctgaggcgggcagatcacgaggtcaggagattgagatcatcctggctaacatggtgaaaccctgtctctactaaaaatacaaaaagttagccaggcgtggtggcaggtgcctgtagtcccagctactcggaaggctgaggcaagagaatggcgtgaacccggtaggtggagcttgcagtgagcagagatcgcgccactgcactccagcctgggcgacagagcaagactccgtctcaaaaaaaaaaaaaaaaagtttaaaaattagccaggtgtggtgatgtgcacctgtagttccagctactcaggagggtgaggcaggaggatcacttgagcccagaagttcaagattgcaatgagctatgatcatgctactgcactccagcctaggcaacagagtgagaccctgtctctaaaaaaataaaaataaagcaagcatataataggttaatccagatggagttaggagggtttataagggcagacacatcctagtaaagaggaaataggcaaactaatgctgttttagtgtaataaggaatgcttataatgatgaactttagtcataaagaaaaggtgaaattatattcagtaacccatgttaggaaagcagaaaactatttaatatgcttggaaagattccaaccagagttaactgaataaaaaccttggacatttgaagagaaaagcatttagttctatctaatttcaatatgcacgtgaattagttcatgttactctaacaatgtattcttactgtccttttttatgaaataggaaagtaaaactgaaagaactatttcttgtgtttttaaaactagccttttctaatatttgatatctaattaaagttagataatatgtaatatgcttttgaacaataatctaaccagaaaatattgtataataaattaccaagaaatcattacattaattataaaaggaacatgtcaatacaacaaatgtttatttaacacctactgttactccaaatactgtgttagaatttgactattcgaagatgaataatagtctttgccctctggaaggccacaatgtagaagtaattctctgtatcagatatttccttgagtgttaagtgtattagtaatcatgttgtaaatcccagtgtaagtcaagaagcaatatcaccaccaccacctccctatgattttgtgataatttggcattttcaatgcttgttaactttcatgttttcatttttatgaaatcatgcagagcttgttataatttttagtggggtttggattaaaatgcttttttgatgtagcagaagatacattttttcccattttacattgttttccttaaatattaagaataatgagtaaaataaactgattttaaaatca

SEQ ID NO: 198087 - DNA, 755 bp, Homo sapiens
  Payload ID: 19073
  Gene Name: UEV and lactate/malate dehyrogenase domains
  Uniprot ID: Q8IX04
  ENST ID: ENST00000541984
  CDS Start-End: 64-663
agcaagtccggaagaaggtccgggggctggagtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagggatattatgatataaatagtgaagtgtttttaagtttgccttgcatccttggaaccaatggagtatctgaagttatcaaaaccacactgaaagaagatacag

SEQ ID NO: 198088 - DNA, 1963 bp, Homo sapiens
  Payload ID: 19073
  Gene Name: UEV and lactate/malate dehyrogenase domains
  Uniprot ID: Q8IX04
  ENST ID: ENST00000535484
  CDS Start-End: 164-1189
aagtgaatgagccgtgccaaaaagacggttggatcctgcatagtggtgagaggggtgatccattctgcctcatcatttaagctgtctggagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagcttaagttactaatgtttcttgtgtaaaatcctgttggtagtaatagtaaagcattgtatttcccttcttcaaattaattacctaccaaaaaatggaaaagaattttacatgcactttaaaatagtaaaatggaaagtgaatttttaaaatatatgcattaaaagtttactttaatttcc

SEQ ID NO: 198089 - DNA, 2503 bp, Homo sapiens
  Payload ID: 19073
  Gene Name: UEV and lactate/malate dehyrogenase domains
  Uniprot ID: Q8IX04
  ENST ID: ENST00000543987
  CDS Start-End: 93-1232
agtttggtcctcagcggcttccgtcctgcagcaagtccggaagaaggtccgggggctggagtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagcttaagttactaatgtttcttgtgtaaaatcctgttggtagtaatagtaaagcattgtatttcccttcttcaaattaattacctaccaaaaaatggaaaagaattttacatgcactttaaaatagtaaaatggaaagtgaatttttaaaatatatgcattaaaagtttactttaatttccagtgggacttcctttatgaaattttccataacctcttcctggagtattacaagatctccaacatctcataaactaattgtgatattagtggaaccataagcaaatatatatttttagtggaaatagattatgaatgaaagccaagcaccttactttaaagccaaaatatgagattttcattaaaaacattggtcataatagggagaggttttttatttgttctgagcaaatcctttaacctctcctgatgatacagttcagagtacacacactttggtgatggatcaagagcaatattttcttatgtgaaagatagcttattattactattgtgacatacaactaatagtaacagttaacatcaacacttcatatataccaggcagcatgataagcactttattattttactgaatcctcacaacagaccactgaggtagggactattgccatcatcattttataaaaggaaattgaggtttagtcctcaagaagtc

SEQ ID NO: 198090 - DNA, 4224 bp, Homo sapiens
  Payload ID: 19074
  Gene Name: UFM1-specific ligase 1
  Uniprot ID: O94874
  ENST ID: ENST00000369278
  CDS Start-End: 67-2451
cttctcccaccgcctgtcggctgacgtgtctgcagttcctccgcgtctactgcgagtcaggccgtgatggcggacgcctgggaagagattaggcggttggcggccgacttccagcgggcgcagttcgccgaggccacgcagaggttgtccgagcggaactgcattgagattgttaataaattgattgctcagaaacagctagaagtagttcatacactcgatggaaaggaatatattactccagcccaaattagtaaagaaatgagagatgagctacatgtccgaggtggtcgagtaaacattgttgatctacaacaggtaattaatgtggacctgattcatattgaaaatagaattggtgacattattaaatcagaaaagcatgttcagttagtgttgggacaactgatagatgagaattatttggatcggttggcagaagaggtcaatgataaattgcaagaaagtggtcaggtcaccatatcagaactgtgtaaaacttatgatcttcctgggaactttctgacacaggcactaactcagcgacttggtagaattatcagtggacatattgatcttgataatagaggagtaatttttacggaagcttttgtagctcgacataaagcacgtatccgtggactattcagtgctattacccggcctacagctgtgaattctttgatttcaaaatatggatttcaggagcagcttctttactctgtgcttgaggaacttgttaatagcggacgcttacgaggcactgtggttggtgggagacaggataaagctgtgtttgtccctgacatctactccaggacacagagtacttgggtggattcctttttcaggcagaatggctatctagaatttgatgctttgtccagacttggaatcccagatgctgtaagctacataaagaaaagatataagactacacaactcttgtttttgaaagcagcttgtgttggtcaaggacttgtggatcaagtggaagcatcagtagaagaagccatcagctctggaacatgggttgatattgcacctctgctacccacttctttatcagttgaagatgctgccatattgcttcagcaggtgatgagggcattcagcaaacaggcctcaactgtagtctttagcgacactgttgtagtcagtgaaaaatttataaatgactgtacagaactgttccgtgagctgatgcaccagaaagctgaaaaggaaatgaaaaataatcctgtgcatttaatcactgaagaagatctgaaacaaatctccactttagaaagcgttagtacaagtaaaaaggataaaaaagatgagcgaagaaggaaagcaacagagggcagtggaagcatgagaggaggaggtgggggcaatgccagagagtacaaaattaaaaaagtcaagaagaaaggaagaaaagatgatgatagtgatgatgaatctcaatcatcccacactggaaagaagaagccagagatcagttttatgttccaggatgagattgaagattttttaagaaaacacatacaagatgcccctgaggagtttatttcggaacttgctgagtacttaataaaacctcttaataaaacttatctcgaggtggtacgttcagtattcatgtcttcaacaacttctgcttctgggacgggcagaaaacgcacaatcaaggacttgcaagaagaagtttcaaacctgtacaataacattaggttatttgaaaaagggatgaagttttttgcagatgacacacaggctgctcttaccaaacacttgctgaagtcagtgtgtactgatatcactaacctcattttcaacttcttagcttcggatttaatgatggcagtagacgatcctgcagccattacaagtgaaataagaaagaaaattttaagtaaattatcagaagaaaccaaagtagctcttacaaaactccataactctctgaatgaaaagagcatagaagactttatttcttgtctggattctgcagcagaagcttgtgatattatggtgaaaaggggagacaaaaaaagggaaagacagatactgttccaacatcgacaagcactggctgaacagctaaaggtcacagaagaccctgctcttattctgcacctcacatcagtcctgttgtttcagttttcaacccacagcatgctccatgcacctggaagatgtgtcccacagatcattgcttttcttaatagtaaaattccagaggatcagcatgctcttttggtaaagtatcaaggtttggttgtaaagcagctagtcagtcaaagtaagaagactgggcagggagattatcccttgaataatgaattagacaaagaacaagaagatgttgccagtactactcgtaaagagcttcaagaactttcttcatccattaaagaccttgttctcaaatctaggaaatcatctgtgacggaagagtaatgatcttaatttacatttgtcatatagtaagcattttcccccaaggttgaaggtgagtggtcacaaaaaagtagtcactatacaactcccctctccctgcaaaaaccacctcatacacacacaattcagttaaaacagtagtattgtattaaatgtaaatcttaaaaagatgtgaatttttgtaaattgggttcttcatggaagtttttttccacctgattttcacacaaatactatatgaaatttttcacattattttcacataattttaaaaattacatatttcaggtttgttctctttccaaatgttgaatgaaaaacaaattttccaatccatttatccctggggaaggattcatttgttgcgagtgccagtatacttaaatgtatactttatatacatttaagcagaaatttaaaatgtggtcttttttttttaaaagaaacacttctgtgtcagaaatgaaaataaatcatgttttttatttttaaatagaaagcacttcaaaactaaaatacagaaatttacaaaaaagaaaaattattactaagcccttgctcttatttttggcagaataaacattgattttggttggggctgcaaggatgcctttacaggtgcacaagaacgctagagtggcccatgcattgctgtgttctcttctaaaacaagctactaacaagagagagaacacatgcaatttattaccagtaagcataagtcatatttaacattggaataactaagcattttatacaaagatttttctttgacccagtttgcatttgtacattttatttttttagttcaacagctgctctgtcacataatactttgtaaatactagtgtgaaaaacagataggatgccttttccagtggtaggagcatctgtaagtgcatttaaatcattagaagcttttttccaaaactagaaacccttattaaaaaatagacatttttttctaaagattattagttaaaaataactaaaagagttccttagagtaatcatttcaaccaaatgaatttcaagcaacaacttacttactatttatcaaaaagggatttaattattttgaatataattataaattaaatttcaaatatttaaaaatactattttatataattccttatgacattttaaactttatattttaaaatatttgaatacgaaaagatcagtctacctctactccattctagacaaagtattaatccttagtgaaagtaattaattaaattgccaacttggcattattattaaacttgataggaacgcaacattaaatttaaaaatgttttcccgtgggtaattttctattatatattttcatatgggcaaagggaaaaaatgataaatcctctgtaatcacaaaccccaatttcgttttgtttattcagcttctaaaatattgaacacccagacttttaattcaacctttaagaaccttatcatttatgtttcagtagatatcaaagtaatccatgtttgtgtcaaatgatcatagaaaataaatagaagagacagtgaagcaagtaaaaagaaaagcattgttttaatttgtttgcattaatttttttcatttgtcaaaatgcttcttttgttgccacagtaaagaacagtttttattgttttgtaagtaaaattacgtagctgattttgtatgtaaagattaatttccataataaaaattattgtatgtttactgtgatcttaatgggcagggttaagaaagttatttaaaataaagttacctattctactaaa

SEQ ID NO: 198091 - DNA, 996 bp, Homo sapiens
  Payload ID: 19075
  Gene Name: UFM1-specific peptidase 1 (non-functional)
  Uniprot ID: Q6NVU6
  ENST ID: ENST00000388761
  CDS Start-End: 448-876
agcattgtgggagctcctcggtcggtgccggtcggtggctgcctattgcggcctgcggtgatcaacgaggcccggggagcgcgtccccagtctgcgcgccggtcctgcggcagctggcccaagacccggagccgaaaggaagtgttggagcctgaggtcgctccgcgccgctaggaggacgctgtgcctggcctgggacctccgctcccgcccaccgccctggagccgctgagggacgtccacgtgggcctgtccccgccgagccgcggccctgtccgcctggcgctgctctcgggccactacctctactaccactacggctgcgacggcctggacgaccgcggctggggctgcggctaccgcactctgcagacgctgtgctcgtggccagagggccagcccgcgggcgtacctggactggccgccgtacaggcggccctggaggacatgggcgacaagccccccggcttccggggctcccgggactggatcggctgcgtggaggccagcctctgcctcgctcacttcggagggccccagggacgcctctgccacgtaccccggggagtggggctgcacggggagctggagaggctttactcgcacttcgcagggggtgggggcccagtcatggttgggggggacgcagatgccaggtccaaggccttgctgggagtctgcgtagggtcaggcacggaagcctatgtcctggtattggaccctcactactggggcactccaaaaagccccagtgaactacaggctgctgggtgggtgggctggcaagaggtgagtgcagcctttgaccccaactccttctacaacctgtgcttgaccagccttagctcccaacagcagcagcgcaccttggactgaggacgaagttacagaactgagattctcgggtcccagacacgcacctatgtacctcccactggtgtccctgcaaagcctggcgcttttgacatcaataataaaagtggcagggctgagcaa

SEQ ID NO: 198092 - DNA, 1630 bp, Homo sapiens
  Payload ID: 19076
  Gene Name: UFM1-specific peptidase 2
  Uniprot ID: Q9NUQ7
  ENST ID: ENST00000264689
  CDS Start-End: 118-1527
agttgtagttggtccgcccgggccccgcccctgggccgtgcggtgacaccacttcagggccggcccccggaacttttgggcaggcgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgattt

SEQ ID NO: 198093 - DNA, 1672 bp, Homo sapiens
  Payload ID: 19076
  Gene Name: UFM1-specific peptidase 2
  ENST ID: ENST00000510755
  CDS Start-End: 102-1265
cccgggccccgcccctgggccgtgcggtgacaccacttcagggccggcccccggaacttttgggcaggcgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagtaacacccgaaaaaacaagaaagtaggaaacattgtctcctagctcattatttgaccgtagtgttggaagtagttcatctgatagaaaatggtttctttctagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaat

SEQ ID NO: 198094 - DNA, 490 bp, Homo sapiens
  Payload ID: 19076
  Gene Name: UFM1-specific peptidase 2
  ENST ID: ENST00000505357
  CDS Start-End: 119-490
gttggtccgcccgggccccgcccctgggccgtgcggtgacaccacttcagggccggcccccggaacttttgggcaggcgtcagcgcccgtgtcaccgccacgtcgcggacatgaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgta

SEQ ID NO: 198095 - DNA, 2348 bp, Homo sapiens
  Payload ID: 19076
  Gene Name: UFM1-specific peptidase 2
  ENST ID: ENST00000514247
  CDS Start-End: 112-375
agttggtccgcccgggccccgcccctgggccgtgcggtgacaccacttcagggccggcccccggaacttttgggcaggcgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcgtccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaagtataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatg

SEQ ID NO: 198096 - DNA, 592 bp, Homo sapiens
  Payload ID: 19076
  Gene Name: UFM1-specific peptidase 2
  ENST ID: ENST00000509180
  CDS Start-End: 1-592
acatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagcatttggaatttgaagtctataaaaggttttttgactggtgcatgtatcttactgaatatagtagcaatattcttgttctgta

SEQ ID NO: 198097 - DNA, 565 bp, Homo sapiens
  Payload ID: 19076
  Gene Name: UFM1-specific peptidase 2
  ENST ID: ENST00000502428
  CDS Start-End: 63-401
agggccggcccccggaacttttgggcaggcgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttg

SEQ ID NO: 198098 - DNA, 1159 bp, Homo sapiens
  Payload ID: 19076
  Gene Name: UFM1-specific peptidase 2
  ENST ID: ENST00000511485
  CDS Start-End: 1-1105
atttagatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaa

SEQ ID NO: 198099 - DNA, 9570 bp, Homo sapiens
  Payload ID: 19077
  Gene Name: UHRF1 binding protein 1
  Uniprot ID: Q6BDS2
  ENST ID: ENST00000192788
  CDS Start-End: 172-4494
atcgtggcggagcgccaggcgcccaaagaggggcgagaaagcgccatggcggcggcggcggctgtgtccggtgctcacgccgcggcgaggtgaggggaccgcctcttctccacaactgaggaggccacagctgccggcccacccgccttccacgcgggccgcggctccggcatggccgggatcattaagaagcagatcctgaaacacctgtcccggttcactaagaatctttccccagacaaaatcaacctgagcaccctgaaaggggagggtcagctgaccaacctggagctggatgaagaggttctacagaatgtactggagctgcccacctggttagccatcactcgggtctactgcaacagggcctccatccggatccagtggacaaagttgaagacacaccctatttgcttgtgtctggataaggtagaggtggagatgaagacatgtgaggatcctcggccccccaatggacagtctcccattgcccttgcttcaggacagagtgaatatggctttgccgaaaaggtggtggaagggatgttcatcattgtcaattctatcaccatcaagattcactccaaggccttccacgcttcttttgaattgtggcagctccagggctatagtgtcaaccccaactggcagcagagtgaccttcgccttacccgcatcactgacccctgccgaggagaggttttaacatttaaggaaataacttggcaaacactccgaattgaggcagatgctacagacaatggtgatcaggacccagtcaccactccattgaggcttattacgaaccaaggcaggatccaaatagccctcaaaagaagaaccaaagattgcaatgtgatatcctccaagctgatgttcctgttggatgacctgctctgggtgctgactgactcacagctcaaggctatgatgaagtatgcagagtcactgagtgaagccatggagaagtcagcccatcaaagaaagagcctggcccctgaacctgtgcagatcactccaccagcccccagtgcccagcagtcctgggcccaggcatttggtggcagccagggcaacagcaacagcagcagcagccgcctcagccagtactttgagaaatttgatgtgaaagagtcctcctaccatctgctcatctcccgcctggacctgcacatttgtgatgatagccagtcccgagagccaggtgtctctgccaacagactcatgggtggtgccatgcagcttaccttccgcaagatggcgtttgactattaccctttccattgggcaggtgatagctgcaaacattgggtacgccactgtgaggccatggagacccgaggccagtgggcccagaagctggtgatggaatttcagagcaaaatggagaagtggcatgaagagacgggtctgaaaccaccctggcaccttggagtagactctctctttcggagaaaagcagattctctttccagtcctcgaaagaaccctcttgagagaagcccctctcagggcagacagcctgcctttcagcctccagcatggaaccgcttacgctctagctgcatggtggtacgggtggatgacctggacatccaccaggtttccaccgctggacagccaagtaaaaagccatctacactcctttcctgcagtcggaaacttcacaacctccctacccaggtctctgccattcatattgagttcacagagtattacttcccagataatcaggagcttccagttccttgtcctaatctctacattcagttaaatggtctgacatttactatggatcctgtcagtttgctctggggaaacctcttttgcctggatttataccgcagcttggagcagttcaaagctatctacaagctggaagattcaagtcagaaagatgaacacttggacatccgactagatgcattctggttgaaggtgagctttccactggaaaagagagagcgggcagagttgcatcgtccccaggcccttgtcttctctgcgtcaggcatgattgccaccaatacacgtcatgctccacattgtagttgttcagacctccagagtctcttccggggttttgctgctgctgagttctttcattccaattatgatcactttcctaaggttccaggtggctttagccttctgcacatgctttttttgcatcatgcctttcagatggattcctgcctgcctcagcctaataccctccctccccagagacctaaggcttcctgggatctctggtctgtccactttacccagatctccttggactttgagggaacagaaaacttcaaaggccataccttgaattttgtagcccccttccccctgtccatttgggcctgcctacccctccgctggcagcaagcccaggcacggaagcttcttttggcctcagaggggaggctgaaaccatcagccagttttggaagtcctgtccagtctgaggctcttgcccctgactctatgtcccatccgcggtcaaagactgaacatgacttgaaaagcttatcaggacttacagaagtcatggaaattctgaaagaaggcagtagtggtatggacaacaaagggcctctgacagagctggaggatgtagcagatgttcatatgcttgtacattccccggcccatgtccgcgtgaggcttgaccactaccagtacttggctctgcttcgcctgaaggaggtgctgcagaggcttcaggagcagctgactaaggatacagagtcaatgactgggtctcccctgcagaatcagacagcttgcattggagttctctttcccagtgctgaagtggctctgcttatgcatcctgcacccggtgctgtcgatgctgactctgcaggctcagatagcactagcctcgtagattcagagctatctccttcagaggatcgggaactgaagtctgatgcctcatcagaccagggcccagcaagccctgagaaggtcttggaggaaagtagcattgaaaatcaggatgtatcccaggagaggccacatagcaatggagaactgcaggactcaggtccacttgcccagcagctggcagggaagggccatgaggcagtagagtccctacaggccaagaaactgagcagaacccaagcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaaggagcccatggccaagacagatgagggggtggcagccccagtgagtggaggtgctgcacgactccgatttttctccatgaagaggacggtatctcaacagtcatttgatggtgtctcattggatagcagtggccctgaagaccggatttcagtggacagtgatggcagtgatagctttgtgatgctcttggagtctgagtctggtccagaatctgttccaccaggatctctttcaaatgtctcagataatgctggtgttcaagggagccctcttgtgaataattatggccaggggtcaccagcagccaacagttcagtttcacccagtggagaagacctcatctttcacccggtctcagttctggtcctgaaggtgaatgaggtgtcttttgggattgaggtacgtggtgaggacctgactgtggccctgcaagcagaggaactgaccctccagcagctgggcaccgtgggactctggcagttcctgcatggacagtgcccaggtacatgctttcaggaatcctcaactttgaagactggccacatcaggccagctgtgggccttcgctttgaggtggggcctggagcagctgttcattcccccctggcctcacaaaatggcttcctacatttattgcttcatggctgtgacctcgagctgctcacttcagtgctcagtggcctggggcccttcttggaggatgaggagatcccggtggtagtccccatgcagattgagcttctgaactccagcatcaccctaaaggatgatatcccccccatctatccaacatctccaggccccatccccatcactctggccatggaacatgttgtgctgaagaggagtgatgatggtgtgttccacataggcgctgctgctcaggacaaaccatcagctgaagtacttaaaagtgagaagagacagcccccaaaagaacaggtgtttttggtgcccacaggagaggtttttgaacagcaggtgaaagaactgcctatcctacaaaaagaacttatagaaactaaacaagccttggccaatgccaaccaggataaagaaaaacttcttcaggagattaggaaatataaccccttctttgagctctgaaaccagtggctcagccatctgtgccaaggagagaggctatcaccagcaatagcaccacctaggacagagggcactgtccagtgctgaataagtcactacggatgccagagggactggggagcactcacttcacttgtgtgggtgtgctttccactagctgttcttacttggactgaggacaagggcaaagcatgattgtatcccaggaaactggggcttgccctgtgtgtggcacaagcatcatgtcttgcctgtataaagccttttggtcctctgtgtactaggtggaatcttctcaacactgtagggccatttcacctcatggtttcatggcagggacatttgcttccttcacaggcctgtgtgaacaagcaaaagtacccacctcctcggtcacccacagagccaccaaagattccatgtcccagagcttcccatagcagacctgaaaagtccatgacctgagctttggccatggtagtggagtggaacaggaaatagtccagcagaggagtgtgggggaagggggcaggagaggcacaagaataagggagacctggactctgcctttttgggaaaaggaaccaagctcatagcaatttggctgataacacaatcagatttttccaggttaagcttcctttctgttatactttcatcattgtgatgctgtggtagaaagtaaataacagtagtggctcagtcatttaatctttcccctctataatacaacttacttgaaatttaaatcaagaaaaaatttctgacgctgagctaggttggtggcatgatatgccaggggtcagtgggggagcttgcttctgagccccctgttgtccgcctggagtcctgcttgtctttcccagctgtgctgagtggctcttctgtctccctggggtccctggcacatctgctttcccagctctgtgaccttaccagttctctcctcagcccttggtggtttgggagctgaatatatgttttaaacttttacataaacaactcaacctgttgcctctcacttccctccatcactgtggcttttaaaactcatgtattttgactcaagtgaaaaaaacacaaaaatccctcatcccagctaggttttgccccctgccctataagagagctatttccccctttctttcctttgaattcttctccaacaccatcccttcattcatactgccctgtgatacacttgaagctgtgttgattggacagacgttcatcagctaacttacctttacttggcaagatggtaaaatagtaacttagtgatgttactaaagtctcgaccattcacctttccatactgaaggaaaggtaaaaaggtttcttctatgggaaattatgcttgacttgcatactctagtttgatgaggataaaaagaaacatgtaattgcagtggtgtttacaactaattgatcacaaccaatcatagatttctttgttccttctccactctcaacacttcatttgactagaaaaaaaaaatgtattcaccaaggaacaggacccaatttgttcagacttttgttaagtttctttactaaggcaatttttgaaacaccagttactatgggatggtgggaatttttcatgcttaagaaatagagacttaggaacaaagaaacatctttctggagaagatgctaatgggaagttacctaaggcttgatgcttggttcaaccttatttaaaatttttataaatgacctgaaagtaggattttacagtgaaatcaaatgtcactacttccaggcagtgaaaggtaatctagaagaggtttaaaaaacacaaaaccggtcgggcacagcggctcacgcctgtaatcccagcactttgggaggccgaggcggggagatcacgagttcaggagatcgagaccatcctggccaacatggtgaaactttgtttccactaaaaatacaaaaattagctgggtgtggtggtgggtgcctgtagttccagccactcgggaggctgaagcaggagaatcgcttgaacccgggaggcagaggttgcagtgagccgagatagcgccattgcactccagcctgtcaacagagtgagactccgtctcacaacaaacaaacaaacacaaaaccacagaagggttactaataagcagggctgagaatactcagaaaactgacaggtgaggttcaacataatataaggaaatgtatttatggaagaattatcaactgatatgcctgaacactgttagaactcaggaaagaaacaagcattgctgagggggaggagagatcaatgtgctgctgtggccaaaagcctaattgccctgtgggcatcatcaggaagggcttttggagataacagagaacagcactttatacaaaaccatggatatgtcttgatcggattatctgtgtttctagtgaccttatttacaagatatatgataaagggaggaaaggtccagagaacagccaaaattatcaggggatggaggtatatccatatgaggacacatttttaaaatatagactctatcctgcaaagatgaaagcagaggggagttagatcaaatatccaatcaagagcaaggacccggtcctgtactactagctctagggctctatctcatagccttagtaaagaaagcacttctcatagcaaatcagaaatgtaaggagctcattgtctaagaagggatgccaccagaaactatacatgggtgcaggtttatgaggaatccttgcatgacggccttctacaaggaattatagaaaagtagggctacttggtaatatacaactgagagggtaactgtgtccctcaacaaactactccttagtgcctctttcaaaggcagaatgttgatctgaatggatcactggtcaagtatggcatctctaatgttcttgaagggggaggaaggagatctggtagctggaaaatataattattccacgttaggctcacctgaattggtttaaaatcatattctgattctcttctcatcccttcctcccctcacccaccatatacctctggcatccctccatgcaaagaaatgtcgaataggcatttcttggtataatttacctacacttgtgcttgtggggtgggagtaaaaacatatccagtaagtaccaaggctaacctcctaatggctggagctcagttaggtctctgggctctctaaaggagtccagagctcttgtccatgtcacaaatggagccttagaatttctgtctttccttatgtggcagctttggccattgtgtcttgaaattctccctcaggaaatgtgataggggatattatcccatgggattttagtaaaaatcagcttgcctaatttcatattcgtgttcataatgaagaaatgcgaagtggtggtagtcctcaggattaagtgtaaaggaaaatatgcaaggaaaaagtagcagtgtcagcccttttggactgcttatgatttctgccttagagctacaagacttggaacaagaaataacaatacctcaagaaaatgtctggagagatagcaccactgtccctcaaagacttcagccactgcacattaccaattcagctgtgaagcatttacaactgtattatctgtgattgtctgcatttcctgtttacatgcatgtgctggggatatgctttagtgtgtatggactagagtttaaatcctgtctttaactgggctgcaaggatggctatcaatcccaaattctgttttcaactcactggaataattaatctggtgttcctgatataaaacaggtgggttctattcacatgatggctgctctttaccatatatttcacctgaccctcattttgccatgggcctcaacctttatgtgtgctttttatggctctgaaaggactggctcccgtgtgtggaatatacaaggtataaacaccacccctcacatacccctgtaacttaaatgcttccatttaactcacttagattactttccccttagtggtaaacgggttgggggatgggtggtagtgcaaagaaggtagtttgaaatattgccatagtaatatgggaactttttattccaaccctttaccctggcttttttttctctcaatatttgcctaaaattctaaaatgagttatagtaaaatcataaaactatggaaacaactgaactttggtacacaagttagttcgatgacatcttgttatttgagaacagtaaaaggtgtgtcattgcctcatgatttatcatagtcattactaagggtttcagagagaatctggtgtgaagcactatcctttcagacactaaggcctttacctagttgctcccctaccttctgtcggaataggattattcccatgcacctctgggtaggtataggtagtagctattgaacggggattattttccccatggcacaaggggaaacactcttggataaccttcaacaatgaggctttgctaagtggccagacttgggatttgatcttcctcacttgttatttattaagtttaagccttattcagtatctctaattgcaatagatatagttcctgtgacttctaaaaaaaattcctgttaatgctgagacagtatcttttttgtcagtttattaatttttggtcaagatttagcctgagtcttaaagcatttatttgtggaatgccccactgaagtgtcttctccattggctaagtacatgtttaaagccatgggttttaatgtaagatactttcagtatctaattctgtttcccccactgagggtgctaaagagaattagaatctttactaagacatgctcaggaaagcttcacgagagaacagcttcaaaatcctccctatgacactgaatggtagtgaggaaagaattcttggggatgccagttacatacaatagccttattactgctaatcactgtcaataaaaggtcacttcattcacctctatttgaggaaaacaatgagaatgtatctgatgaactagaatccttgtcagtattgggaaattttaatgttgcaatatctagtcaaactttgagtgtactggttctgtgaaccacctgaaaaaacaaattaaatgtattaaaccataa

SEQ ID NO: 198100 - DNA, 4706 bp, Homo sapiens
  Payload ID: 19077
  Gene Name: UHRF1 binding protein 1
  ENST ID: ENST00000452449
  CDS Start-End: 237-4439
gcgggtggcgcgcgatcttcgcgtcgctctgggcgggcggccgcggcgccgcgctggtgggtgggatcgtggcggagcgccaggcgcccaaagaggggcgagaaagcgccatggcggcggcggcggctgtgtccggtgctcacgccgcggcgaggtgaggggaccgcctcttctccacaactgaggaggccacagctgccggcccacccgccttccacgcgggccgcggctccggcatggccgggatcattaagaagcagatcctgaaacacctgtcccggttcactaagaatctttccccagacaaaatcaacctgagcaccctgaaaggggagggtcagctgaccaacctggagctggatgaagaggttctacagaatgtactggagctgcccacctggttagccatcactcgggtctactgcaacagggcctccatccggatccagtggacaaagttgaagacacaccctatttgcttgtgtctggataaggtagaggtggagatgaagacatgtgaggatcctcggccccccaatggacagtctcccattgcccttgcttcaggacagagtgaatatggctttgccgaaaaggtggtggaagggatgttcatcattgtcaattctatcaccatcaagattcactccaaggccttccacgcttcttttgaattgtggcagctccagggctatagtgtcaaccccaactggcagcagagtgaccttcgccttacccgcatcactgacccctgccgaggagaggttttaacatttaaggaaataacttggcaaacactccgaattgaggcagatgctacagacaatggtgatcaggacccagtcaccactccattgaggcttattacgaaccaaggcaggatccaaatagccctcaaaagaagaaccaaagattgcaatgtgatatcctccaagctgatgttcctgttggatgacctgctctgggtgctgactgactcacagctcaaggctatgatgaagtatgcagagtcactgagtgaagccatggagaagtcagcccatcaaagaaagagcctggcccctgaacctgtgcagatcactccaccagcccccagtgcccagcagtcctgggcccaggcatttggtggcagccagggcaacagcaacagcagcagcagccgcctcagccagtactttgagaaatttgatgtgaaagagtcctcctaccatctgctcatctcccgcctggacctgcacatttgtgatgatagccagtcccgagagccaggtgtctctgccaacagactcatgggtggtgccatgcagcttaccttccgcaagatggcgtttgactattaccctttccattgggcaggtgatagctgcaaacattgggtacgccactgtgaggccatggagacccgaggccagtgggcccagaagctggtgatggaatttcagagcaaaatggagaagtggcatgaagagacgggtctgaaaccaccctggcaccttggagtagactctctctttcggagaaaagcagattctctttccagtcctcgaaagaaccctcttgagagaagcccctctcagggcagacagcctgcctttcagcctccagcatggaaccgcttacgctctagctgcatggtggtacgggtggatgacctggacatccaccaggtttccaccgctggacagccaagtaaaaagccatctacactcctttcctgcagtcggaaacttcacaacctccctacccaggtctctgccattcatattgagttcacagagtattacttcccagataatcaggagcttccagttccttgtcctaatctctacattcagttaaatggtctgacatttactatggatcctgtcagtttgctctggggaaacctcttttgcctggatttataccgcagcttggagcagttcaaagctatctacaagctggaagattcaagtcagaaagatgaacacttggacatccgactagatgcattctggttgaaggtgagctttccactggaaaagagagagcgggcagagttgcatcgtccccaggcccttgtcttctctgcgtcaggcatgattgccaccaatacacgtcatgctccacattgtagttgttcagacctccagagtctcttccggggttttgctgctgctgagttctttcattccaattatgatcactttcctaaggttccaggtggctttagccttctgcacatgctttttttgcatcatgcctttcagatggattcctgcctgcctcagcctaataccctccctccccagagacctaaggcttcctgggatctctggtctgtccactttacccagatctccttggactttgagggaacagaaaacttcaaaggccataccttgaattttgtagcccccttccccctgtccatttgggcctgcctacccctccgctggcagcaagcccaggcacggaagcttcttttggcctcagaggggaggctgaaaccatcagccagttttggaagtcctgtccagtctgaggctcttgcccctgactctatgtcccatccgcggtcaaagactgaacatgacttgaaaagcttatcaggacttacagaagtcatggaaattctgaaagaaggcagtagtggtatggacaacaaagggcctctgacagagctggaggatgtagcagatgttcatatgcttgtacattccccggcccatgtccgcgtgaggcttgaccactaccagtacttggctctgcttcgcctgaaggaggtgctgcagaggcttcaggagcagctgactaaggatacagagtcaatgactgggtctcccctgcagaatcagacagcttgcattggagttctctttcccagtgctgaagtggctctgcttatgcatcctgcacccggtgctgtcgatgctgactctgcaggctcagatagcactagcctcgtagattcagagctatctccttcagaggatcgggaactgaagtctgatgcctcatcagaccagggcccagcaagccctgagaaggtcttggaggaaagtagcattgaaaatcaggatgtatcccaggagaggccacatagcaatggagaactgcaggactcaggtccacttgcccagcagctggcagggaagggccatgaggcagtagagtccctacaggccaagaaactgagcagaacccaagcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaaggagcccatggccaagacagatgagggggtggcagccccagtgagtggaggtgctgcacgactccgatttttctccatgaagaggacggtatctcaacagtcatttgatggtgtctcattggatagcagtggccctgaagaccggatttcagtggacagtgatggcagtgatagctttgtgatgctcttggagtctgagtctggtccagaatctgttccaccaggatctctttcaaatgtctcagataatgctggtgttcaagggagccctcttgtgaataattatggccaggggtcaccagcagccaacagttcagtttcacccagtggagaagacctcatctttcacccggtctcagttctggtcctgaaggtgaatgaggtgtcttttgggattgaggtacgtggtgaggacctgactgtggccctgcaagcagaggaactgaccctccagcagctgggcaccgtgggactctggcagttcctgcatggacagtgcccaggtacatgctttcaggaatcctcaactttgaagactggccacatcaggccagctgtgggccttcgctttgaggtggggcctggagcagctgttcattcccccctggcctcacaaaatggcttcctacatttattgcttcatggctgtgacctcgagctgctcacttcagtgctcagtggcctggggcccttcttggaggatgaggagatcccggtggtagtccccatgcagattgagcttctgaactccagcatcaccctaaaggatgatatcccccccatctatccaacatctccaggccccatccccatcactctggccatggaacatgttgtgctgaagaggagtgatgatggtgtgttccacataggcgctgctgctcaggacaaaccatcagctgaagtacttaaaagtgagaagagacagcccccaaaagaacaggtgtttttggtgcccacaggagaggtttttgaacagcagacatagcaataacaacattctgagacacagaggtgccagtgatggactggatcagcttgaaagaagcacaaagactccgtgatcacaatagtcaaagactggctttggaacacagtaccaagtaattcacagaaaaagtttttggctgcaggattaagtaatgatgagtcttccctttcaactgttgttaaatctgagacatcctgactctcgagctgggaagatgaaagaaactctattatatatttggcctactttccaggcttgggcaaa

SEQ ID NO: 198101 - DNA, 5168 bp, Homo sapiens
  Payload ID: 19078
  Gene Name: UHRF1 binding protein 1-like
  Uniprot ID: A0JNW5
  ENST ID: ENST00000279907
  CDS Start-End: 214-4608
agatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatgggtttgg

SEQ ID NO: 198102 - DNA, 2023 bp, Homo sapiens
  Payload ID: 19078
  Gene Name: UHRF1 binding protein 1-like
  Uniprot ID: A0JNW5
  ENST ID: ENST00000356828
  CDS Start-End: 213-1781
gatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaactgccttcctaagcagatgagaaaactcaagatagatgaaggaagacatctgctctgcatctcatagggagtaaaatggcacagttgaaactcaagcattgtcttgtaaatctaaattcattgttttttctccactgtattacactgctcccctttgcccctgtattcaccacggccattgtctgttattgcataatcatagtattccagccatgcccccataattgtttttcttaaataaaatatatcattgaacaagtaa

SEQ ID NO: 198103 - DNA, 4088 bp, Homo sapiens
  Payload ID: 19078
  Gene Name: UHRF1 binding protein 1-like
  ENST ID: ENST00000545232
  CDS Start-End: 251-3595
agccaataagggaaggcagaaggaagtagatttaagggagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaa

SEQ ID NO: 198104 - DNA, 581 bp, Homo sapiens
  Payload ID: 19078
  Gene Name: UHRF1 binding protein 1-like
  ENST ID: ENST00000550544
  CDS Start-End: 380-581
attttgaagctgaaaaagtataaggaaagaagtacaggagactattttgcaatattaccatcatagacataaatactattctgttaagacttgcaaggaagattttggtagcttaggttgtgattggtaacagagatggcagtcgtagttaaagactaatagattgaagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttctt

SEQ ID NO: 198105 - DNA, 713 bp, Homo sapiens
  Payload ID: 19078
  Gene Name: UHRF1 binding protein 1-like
  ENST ID: ENST00000548712
  CDS Start-End: 1-614
gttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagttgaacaagagatttttcaatcaagactttggaactacgaagatggaagagatttgaagagggatatagaatgagtaaattaagcaactttttaatatcctatttctataaatatccagaatttaaaacattcctgtattataatatctaaaaaca

SEQ ID NO: 198106 - DNA, 664 bp, Homo sapiens
  Payload ID: 19078
  Gene Name: UHRF1 binding protein 1-like
  ENST ID: ENST00000551973
  CDS Start-End: 273-664
agttggtagtaccgttagccaataagggaaggcagaaggaagtagatttaagggaggtgaggagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaa

SEQ ID NO: 198107 - DNA, 559 bp, Homo sapiens
  Payload ID: 19078
  Gene Name: UHRF1 binding protein 1-like
  ENST ID: ENST00000547428
  CDS Start-End: 190-327
cggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagcgttccctgctggctgtggtggagattggtgtgctgtgaattgcataatcacccaaatgagtaccagaggagtctaagaaaccctggcaactgactgcttgctttcaccaggaatagggacctttttctgaatttcctgccctcagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaact

SEQ ID NO: 198108 - DNA, 542 bp, Homo sapiens
  Payload ID: 19078
  Gene Name: UHRF1 binding protein 1-like
  ENST ID: ENST00000548045
  CDS Start-End: 234-542
agaaggaagtagatttaagggagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggat

SEQ ID NO: 198109 - DNA, 560 bp, Homo sapiens
  Payload ID: 19078
  Gene Name: UHRF1 binding protein 1-like
  ENST ID: ENST00000551980
  CDS Start-End: 380-560
attttgaagctgaaaaagtataaggaaagaagtacaggagactattttgcaatattaccatcatagacataaatactattctgttaagacttgcaaggaagattttggtagcttaggttgtgattggtaacagagatggcagtcgtagttaaagactaatagattgaagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcata

SEQ ID NO: 198110 - DNA, 3142 bp, Homo sapiens
  Payload ID: 19079
  Gene Name: UL16 binding protein 1
  Uniprot ID: Q9BZM6
  ENST ID: ENST00000229708
  CDS Start-End: 44-778
gggaaccatcagcgcctcctgtccacggagctccaggtctacaatggcagcggccgccagccccgcgttccttctgtgcctcccgcttctgcacctgctgtctggctggtcccgggcaggatgggtcgacacacactgtctttgctatgacttcatcatcactcctaagtccagacctgaaccacagtggtgtgaagttcaaggcctggtggatgaaaggccttttcttcactatgactgtgttaaccacaaggccaaagcctttgcttctctggggaagaaagtcaatgtcacaaaaacctgggaagaacaaactgaaacactaagagacgtggtggatttccttaaagggcaactgcttgacattcaagtggagaatttaatacccattgagcccctcaccctgcaggccaggatgtcttgtgagcatgaagcccatggacacggcagaggatcttggcagttcctcttcaatggacagaagttcctcctctttgactcaaacaacagaaagtggacagcacttcatcctggagccaagaagatgacagagaagtgggagaagaacagggatgtgaccatgttcttccagaagatttcactgggggattgtaagatgtggcttgaagaatttttgatgtactgggaacaaatgctggatccaacaaaaccaccctctctggccccaggcacaacccaacccaaggccatggccaccaccctcagtccctggagccttctcatcatcttcctctgcttcattctagctggcagatgaggagagttgtttagagtgacaggtggaaagtgatatcaagaagcctctgttagcctggtctgggtcctgctctcccttcagggaggccgcctgtctactcaccactgtgcctttctggaaagcaggagttcaagccttagcaagcccagaggcccccagcagacgatgaggacattgtcggctcaacatctcaggccactcattaccttcgctcatgatcccagcagccatttttcttaacaccttctgccactttctgtcggtgctaatggatggaactcctgcacaagttttaactgaacaagaaatcccagcaaaaggcatttttttttctacttctttgattgtagaaaagcagacacttctctgaaacatgaccttattcttccaaacagtatcgctagtaaaatagcatgctggacttcagacctcagggatccttttgatgcactgaccaggaattgtgataatccttttcatttttatggctttttacagtttctcattctgtcaaccatattgaagtgaagtggcatagtcttcactcactgtaatctccagctcctgggctcaagtgatcctctagactcagcctctagaatagctgggactacaggcacatgccaccaggactggcaaactgttttatttttaggtagaggtagggtcttcctatgttgcccaggatggtcttcaaatcttggtctcgagcaatgctaccaccttggcctcccaatgctctgggattacagacatgaaccacagtgcctgttgtagaaatttttaattatttaatatgaaaatattacattcatgattattttatttagtaaataaaataatagagagcccagaaatcaacctgcacacctaccgccatctaatcttcaatagaaatgggcaatgtgggaaagactccctattcgaaaattagtgctggaatatctggccaaccatatgcagaagaatgaaactgaacccctacttctccccatatatgtaaaataattcaatatggatgaaagatttaaatataagtactaaaactgtaaaaatcctggaatataacctaagaaataccaatgtggacatagggcctggcaaagatttcatgaagaagacactaaaaacaattgcaacaaaaacagaaattgacaaatggggcctcattaaactaaagagcttctgcacagaaaaagaaactagcaacacagtaaacagacagcctgtagaatggggaaaactatttgcaaactctgcatctgatgaaggtccaatatccagaatctacaaggaacttaaacaattcaacaagcaagaagaaaaaacccaattaaaattgggcaaaggcatgaacagacacttttcaaaagaagacctacaattggccaacaaacatgaaaaaatgctcagtatcactaatcatcagataagtgcaaatcaaaactgcaatgagttaccatctcttaccagtcacaaagtcagagatggtggtgaggctgcagagcaaaagaaacagacactgttggtgggaaagcaaacttgttcagccactatggaaagcagtttggagatttctccaagaacttaaaatagaactaccattcaatcccgcaatcccactactcgggatatacccacaggaaaagaattcattttatcaaaaagacacctgcaccaatatgttcattacagtgctattctcaccagcaaggacagagaatcaatctaagtgcccaacaacagtaaattcaatgaaaaaaaatgtggtacatagatacgatggaaaactatgcagccatgaaacacaagaaaatcatgtccttttcagcaacatggatgcaactagaggctattatcctaagcaacctaatgcaagaacagaaaaccacatactgcatcttcccattggaaagtggcagctaaacattaaattcgcatgaaccacagatgctggagatcaccagaccggggagagaagaggggcacctgggctgaaaaacacacctgttgggtatcatgcttactgtctgggcgatgggatcattgggacaccaagcctcagcttctcaaattctacccatgtaacaaacctgtatatgtaccttgtattatataggttgaaattaaagatgaataaataaaataaaatgacacaaggccaaaaacaaatgggtttaactgaccagagcgagagaactctgcactatgaacccaaacccagctcaaaaagataaaatctagtcatttaagataatcataagttgtatgatgataattgtataaaaatttgtatgatgataattgtataataattatacatgaaagtgccaaaaccctacaattaaacactgtataatggaa

SEQ ID NO: 198111 - DNA, 1349 bp, Homo sapiens
  Payload ID: 19080
  Gene Name: UL16 binding protein 2
  Uniprot ID: Q9BZM5
  ENST ID: ENST00000367351
  CDS Start-End: 74-814
aaaaccttgaggtgattcatcttccaggctctccttccatcaagtctctcatccctagcgctctgggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggcaaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaa

SEQ ID NO: 198112 - DNA, 988 bp, Homo sapiens
  Payload ID: 19081
  Gene Name: UL16 binding protein 3
  Uniprot ID: Q9BZM4
  ENST ID: ENST00000367339
  CDS Start-End: 30-764
ccttgtgtcccgggcgctcctggtctacaatggcagcggccgccagccccgcgatccttccgcgcctcgcgattcttccgtacctgctattcgactggtccgggacggggcgggccgacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaaggatagcggactgaccaccttcttcaagatggtctcaatgagagactgcaagagctggcttagggacttcctgatgcacaggaagaagaggctggaacccacagcaccacccaccatggccccaggcttagctcaacccaaagccatagccaccaccctcagtccctggagcttcctcatcatcctctgcttcatcctccctggcatctgagaagagtcatttagagtgacaggtggaaggtgatatcaagaagcctctgttagcctggtctggttcctgctctcccttcagggaggccgcctgtctactcaccactgtgcctttctggaaagcaggagttcaagccttagcaagcccagaggcccccagcagatgatgaggacattgtcggctcaacatctcaggccactcattaccttcgctcatgatcccag

SEQ ID NO: 198113 - DNA, 735 bp, Homo sapiens
  Payload ID: 19081
  Gene Name: UL16 binding protein 3
  Uniprot ID: Q9BZM4
  ENST ID: ENST00000438272
  CDS Start-End: 1-735
atggcagcggccgccagccccgcgatccttccgcgcctcgcgattcttccgtacctgctattcgactggtccgggacggggcgggccgacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaaggatagcggactgaccaccttcttcaagatggtctcaatgagagactgcaagagctggcttagggacttcctgatgcacaggaagaagaggctggaacccacagcaccacccaccatggccccaggcttagctcaacccaaagccatagccaccaccctcagtccctggagcttcctcatcatcctctgcttcatcctccctggcatctga

SEQ ID NO: 198114 - DNA, 2048 bp, Homo sapiens
  Payload ID: 19082
  Gene Name: UNC homeobox
  Uniprot ID: A6NJT0
  ENST ID: ENST00000316333
  CDS Start-End: 112-1707
tccgggtccctgtctccgccgccgccgcccgcgcctcccgccgctggcccgccccggccccggcccgcgcccccgcgccccgccaccggccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcagactcgggggacccggacaaggagagcccgggctgcaagcggcggcgcacccgcaccaacttcaccggctggcagctggaggagctggagaaggcgttcaacgagagccactatcccgacgtgttcatgcgcgaggcgctggcgctgcgcctagacctggtcgagtcccgagttcaggtctggttccaaaaccgccgggccaagtggaggaagaaggagaacacgaaaaagggcccggggcggccggcgcacaactcgcacccgaccacgtgcagcggcgagcccatggacccggaggagatcgcgcgcaaggagctggagaagatggagaagaagaagcgcaagcacgagaagaagctgctgaagagccagggccgccacttgcactcgcccggcggcctgtccctgcacagcgcgcccagctccgacagcgacagcggcggcggcggcctgtctccggagccgcccgagccgccgccgcccgccgccaagggccccggagcgcacgcctcgggcgccgcggggaccgcgcccgcccctcccggcgagccgcctgcacccggcacctgcgaccccgccttctacccgagccaaagaagcggcgccggcccacagccgcgcccaggtcgccctgcggacaaggacgcggcctcgtgcgggccaggggccgctgtggcggcggtggagcgcggcgccgcggggctgcccaaggccagcccattcagcgtggagagcctcctgtccgactcgccgccgcgccggaaagccgcttccaacgccgccgccgccgccgccgcggggctggacttcgcgcccgggctgccgtgcgcgccgcggaccctgatcggcaagggccacttcctcctctaccccatcacgcagccgctcggcttcctggtgccgcaggccgcgctcaagggcggcgcgggcctggagccggcgcccaaggacgcgccgcccgcgcccgccgtgccgcccgcgccgcctgcccaggccagtttcggggccttctcggggcccggcggcgccccggactcggccttcgcgcgtcgcagccccgacgccgtcgcctccccgggggccccagccccggccccggcgcctttccgggacctcgcctcggcagcggctaccgagggcggcggcggggactgcgcggacgcggggaccgccggccccgcgcccccgccgcccgcgccgtcgcccaggcccggccctcggcctcccagccccgccgaggagccggccacctgcggggttcccgagcctggcgcggcggccggacccagcccgccggagggcgaggagctggacatggactgaggccgcggcggccgggagaggcgcgtagccggcccgcggccgctcgctcaggctccgactcacgcaacgaatcaggtgatcggctctagaaacactgctttcccttcttttcttttgttttctttcttttattattttttttaagagtaaacgaaagtgctgtatgaattcggacccaggcagcaaccacaggactgggggtgagaccctcctcctcccaagagagcaaaaaggacccatggcccccaaaaaaccccacaacgagaatcctcagccttgtaaaatgcaaaaatgtctaagaatatttatatatgtaccatttttgataaataaagctggtc

SEQ ID NO: 198115 - DNA, 1653 bp, Homo sapiens
  Payload ID: 19083
  Gene Name: unc-119 lipid binding chaperone
  Uniprot ID: Q13432
  ENST ID: ENST00000301032
  CDS Start-End: 75-737
gctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgagtgcgcgggcagggtcttctgggagtggggaagtgggggcgtctagagactgagctgcgggagggagagggacttgtgggtctgatcccatttctccccaccctggggctcttctgtgtctgccaccattcccatatcatccgtagagaaagaggctggggatatttcaggctgtttggctgtccctgtaccccagtcctgaagcccctgcagtggcgggactcaagctcctgacctttgcccggcctggctgggcctctcttgcagtcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgtt

SEQ ID NO: 198116 - DNA, 1424 bp, Homo sapiens
  Payload ID: 19083
  Gene Name: unc-119 lipid binding chaperone
  Uniprot ID: Q13432
  ENST ID: ENST00000335765
  CDS Start-End: 112-834
agtacctggggccccggccgggggcggggctgcggatgctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttc

SEQ ID NO: 198117 - DNA, 676 bp, Homo sapiens
  Payload ID: 19083
  Gene Name: unc-119 lipid binding chaperone
  ENST ID: ENST00000444148
  CDS Start-End: 53-676
gccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtggggcccgtccccttttcccagcgtggaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgagtgcgcgggcagggtcttctgggagtggggaagtg

SEQ ID NO: 198118 - DNA, 538 bp, Homo sapiens
  Payload ID: 19083
  Gene Name: unc-119 lipid binding chaperone
  ENST ID: ENST00000581945
  CDS Start-End: 1-259
gaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgagtgcgcgggcagggtcttctgggagtggggaagtgggggcgtctagagactgagctgcgggagggagagggacttgtgggtctgatcccatttctccccaccctggggctcttctgtgtctgccaccattcccatatcatccgtagagaaaga

SEQ ID NO: 198119 - DNA, 2050 bp, Homo sapiens
  Payload ID: 19083
  Gene Name: unc-119 lipid binding chaperone
  ENST ID: ENST00000470125
  CDS Start-End: 760-1137
gaggagggggtttggaggagaggaggaatagggaaggggttgttcacctgccccagccccacccatatcagggaaagtccccttaacatcagcctcacctgatacatctagatgtcatgccaggggcagctgtggggtgagggtaggagtatcctccagagaaggacagtgactctcccaagacagagctgtgtggccccctttacaggtggttctcaaaggcagggtaccagagaagttgatacactgagttgcagtagaagagacaggtcagactgcaggaagttgttcccatatgagaagagaggctcccaccaggctggatacctaattctcccaaagtcatctagccagccttggcagagcggaggccagaatgaggaccctcaactccagagtgggagagagagtgttcaggaggtggccttgtcctctacccttctctgccctgcccttccctggcccccagagaccagtaggatggcactccttatcccctgttagatccccatggcggagttatgtctcttccacactgggggtgtaccccaagggcagggactgaggtccctctttccagagggcagtgatcccagggatgagaagatggtagctactctggggtcccacacaagctgacctggcagcaggggctttgcggccccttccttgctcagctgcctgtttcccctagactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgagtgcgcgggcagggtcttctgggagtggggaagtgggggcgtctagagactgagctgcgggagggagagggacttgtgggtctgatcccatttctccccaccctggggctcttctgtgtctgccaccattcccatatcatccgtagagaaagaggctggggatatttcaggctgtttggctgtccctgtaccccagtcctgaagcccctgcagtggcgggactcaagctcctgacctttgcccggcctggctgggcctctcttgcagtcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttct

SEQ ID NO: 198120 - DNA, 4189 bp, Homo sapiens
  Payload ID: 19083
  Gene Name: unc-119 lipid binding chaperone
  ENST ID: ENST00000484980
  CDS Start-End: 3163-3600
gtgtgttggctgtggttcctctcatggggagtggcataatgtccctccaagcctggactagcacctgtcctcttctgggggctctgtcatcaagggaggcttggtctccactgtggttaagagtttctgagctggactgcctgggttggagttccaactctgccatataattgtctgtgtgaccttgggcaagtaacctcacctctctgagcatgtcttttcatctgtaaaatggggataatgatacctttctcgtaagattattgtgaagataagtcctctgattctgtacagtgcctggcatctatgcatgctgtgtacattgggctctttgatcagtagtatttttgggccctacagggctgctcatagctgctgcctggagtcaaacaacttggctttcagggcaggggagggggtcatcataggcagggaacgagggctaggaaacctcatagcagaggctttggatgagcctcaaaggatgaaaggtgcatggagagacagtggctctccaccttggccacattcaccagcaacctgccctggccccctttgtgagaataactgttggggggggcctctctgtgggtatggggggcatgtattggagtggacctgagccctagagcttccaaagcagcagaacaccggactcccagacagagctgtggaggggagacagccttgagcctgtgctcctgggtccctgggggccaattcctctctccttactgagctaggcagcagccattcttagctgggcccccagagtactgagctcccttgcccaagcaggcatcaatggagagagggaggctggaccaggctgatgttgaagccagttgggctacaatttgcaatagcagcatttaggattcagcttagctctggggcagaactttctcagactgactgagtcctgagtaactttgggggtttattttgcaactagagggagcttccagctcatgtaccaccatttgtctcctaatttggaggaaattcatagcccttagagatggggcatctgtgaagggtaagtagaggaaagggcttcatgagaaccccttcctgtgcaggaattgagaacagagttccagggatttccaccctggcaccccttgcctggtctcttctgaccctaatcatgcaggtctgaggtttgctgttcccagattactgggccctgaatccagcttaggaagctatttgtggctgagaggaatagagcagttgtgttctgagcccttggccactctgccccttattctgacctgaccctgggtcccaggcctcatcctttctagaagagaaggagtggccgtggtgttctgagccatagatatccgtgttcctcacttcttctaaggacagagaggttgatagattgagtttgcagtagaagagactgaggttagactgcaggaagttgttcccaaatgagagaggctccaaaagttggagaatgggagaagagaaggccttacagggatctgggagttgggcactgggatcctgctccccactctgccacctccgttccctatgctctgtaccttctttctatgtctttatactggtgcttactttctgtgaaaatagggtgaatggggtgagataggggttgcccacttccattctctccccaccccacatgtgggctgtagtagactcagggccctgcctcttccccaagctgtataaagtccatgctgggccccagggtaccagatggctgccaggagggcttcctggaggggacagcgtcaggcttggggaagaagcagacctggggaagagaaaatgactttatattcacttcctgttcctgccccagaggaataggaggtggcccaggggcctggagggtgatttccaggcctctgtgggccaccaggggaggatgtgatgctgtgcaggctgacagcacgagtccctccctgcacctctcagctctttttgttgccagggcctccctgagcacttgaagttgctgctgcaagagctgtgagggttagatcaggccctgtagctccctgagcttcctcaggcagggcctcccactgttcttggttcccttcctgggcctgaggactccccttaccccttccacacccactgctgcacctgccacaccctcctcctggcctagcctgtgttcttctctatgggggtccaggactactttctccatggtggtggctcatagccagggctgcgtaaatgacctctaagggggttctctctgcttgctaagacttcctcccatttggagatcaacaaaggatgagagcaaagttggcctcctcccacctgccatatcccaggctctgggcttgagtcagcagagctttggttaagctgcttaagggagctgggctggtgtaagcttcttactgagaggagggggtttggaggagaggaggaatagggaaggggttgttcacctgccccagccccacccatatcagggaaagtccccttaacatcagcctcacctgatacatctagatgtcatgccaggggcagctgtggggtgagggtaggagtatcctccagagaaggacagtgactctcccaagacagagctgtgtggccccctttacaggtggttctcaaaggcagggtaccagagaagttgatacactgagttgcagtagaagagacaggtcagactgcaggaagttgttcccatatgagaagagaggctcccaccaggctggatacctaattctcccaaagtcatctagccagccttggcagagcggaggccagaatgaggaccctcaactccagagtgggagagagagtgttcaggaggtggccttgtcctctacccttctctgccctgcccttccctggcccccagagaccagtaggatggcactccttatcccctgttagatccccatggcggagttatgtctcttccacactgggggtgtaccccaagggcagggactgaggtccctctttccagagggcagtgatcccagggatgagaagatggtagctactctggggtcccacacaagctgacctggcagcaggggctttgcggccccttccttgctcagctgcctgtttcccctagactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgtt

SEQ ID NO: 198121 - DNA, 4404 bp, Homo sapiens
  Payload ID: 19084
  Gene Name: unc-119 lipid binding chaperone B
  Uniprot ID: A6NIH7
  ENST ID: ENST00000344651
  CDS Start-End: 41-796
accgcgctgtggaggcggcggccatcttggcggcggagcgatgagcgggtctaacccgaaggctgcggccgcggcgtcggcggctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgctggacaccatccggcccgagcacgtcctgcgcctcagccgggtcaccgagaattatttatgtaaacccgaagacaacatctacagtattgatttcacccgcttcaaaattcgagatttggagacagggacagtactttttgagattgccaaaccttgcgtttcagaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcattcgtctaatgattgaaaatccttacgagacccgctctgacagcttctactttgttgacaacaagctgataatgcacaacaaggctgattatgcctataatggaggccagtaagtgctgcaagagtagataggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaagggtggggagggagggaggtgccaagagtggaggcaccaaggaatgggtgatgctgccaagctgaagggtctgctttgtggagaggctgctgctctgtctgacttccagggtctcagccagccctcctgggaatagaccaagttttcagcctggcagtgccttctgttcccattttggaggacagacaagcttgctccacatctcctggctcctcccttctgagtctcatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgactcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtgtaaagtcattgaagttgtgaaagtctattttttttcctgtaaatctattttttacagaatataagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacagta

SEQ ID NO: 198122 - DNA, 9837 bp, Homo sapiens
  Payload ID: 19085
  Gene Name: unc-13 homolog A (C. elegans)
  ENST ID: ENST00000252773
  CDS Start-End: 1-5112
ctgtctctcctctgtgtctctctcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttggccatgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttcccgacatgtgaatggcccaagtgtctggaagaagtggcgccactttctaatttgcttggagatgttgcatgtcccttaaattcagacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaaggggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagagggtgtcctgaagaaagaaggatctgttcactcttaccagtctgtcctcgaatgatttgcataaaatgaggaggtgcctgtccacacccccaattcctctctcaggccccagagcctgagacctcaccatgcccccatcagagatgcaaaaaactaaacacccaactagaaatccttgggacctctctcggctgggatctcagagcctttctgtcccctacccctaccccatgtgctgtcgattttgcagatggggacaacctggggcctcccggaactctgccaccctggggaagttgggggagggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacacagccttgg

SEQ ID NO: 198123 - DNA, 9838 bp, Homo sapiens
  Payload ID: 19085
  Gene Name: unc-13 homolog A (C. elegans)
  Uniprot ID: Q9UPW8
  ENST ID: ENST00000519716
  CDS Start-End: 1-5112
atgtctctgctttgcgttggagtcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttggccatgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttcccgacatgtgaatggcccaagtgtctggaagaagtggcgccactttctaatttgcttggagatgttgcatgtcccttaaattcagacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaaggggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagagggtgtcctgaagaaagaaggatctgttcactcttaccagtctgtcctcgaatgatttgcataaaatgaggaggtgcctgtccacacccccaattcctctctcaggccccagagcctgagacctcaccatgcccccatcagagatgcaaaaaactaaacacccaactagaaatccttgggacctctctcggctgggatctcagagcctttctgtcccctacccctaccccatgtgctgtcgattttgcagatggggacaacctggggcctcccggaactctgccaccctggggaagttgggggagggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacacagccttgga

SEQ ID NO: 198124 - DNA, 5200 bp, Homo sapiens
  Payload ID: 19085
  Gene Name: unc-13 homolog A (C. elegans)
  ENST ID: ENST00000550896
  CDS Start-End: 167-5197
gcgctgtccgcgcccccggtgctgaaccaagatggccggtggcggccgggccccggcgtgagccaagcgcgggctgcagccgggagatgccccagcccagcggccgctgagcccgacccgacagagccggcccggccgcctccggcccacctgcgagctcggagacatgtctctgctttgcgttggagtcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgc

SEQ ID NO: 198125 - DNA, 6052 bp, Homo sapiens
  Payload ID: 19085
  Gene Name: unc-13 homolog A (C. elegans)
  ENST ID: ENST00000551649
  CDS Start-End: 151-5319
cggtgctgaaccaagatggccggtggcggccgggccccggcgtgagccaagcgcgggctgcagccgggagatgccccagcccagcggccgctgagcccgacccgacagagccggcccggccgcctccggcccacctgcgagctcggagacatgtctctgctttgcgttggagtcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttggccatgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccaggtccatggtggaaaaggtactaggtttacccttagtgaagacatttatcctgagaagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagag

SEQ ID NO: 198126 - DNA, 5314 bp, Homo sapiens
  Payload ID: 19085
  Gene Name: unc-13 homolog A (C. elegans)
  ENST ID: ENST00000552293
  CDS Start-End: 128-5221
tggcggccgggccccggcgtgagccaagcgcgggctgcagccgggagatgccccagcccagcggccgctgagcccgacccgacagagccggcccggccgcctccggcccacctgcgagctcggagacatgtctctgctttgcgttggagtcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttggccatgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccaggtccatggtggaaaaggtactaggtttacccttagtgaagacatttatcctgagaagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggc

SEQ ID NO: 198127 - DNA, 6303 bp, Homo sapiens
  Payload ID: 19086
  Gene Name: unc-13 homolog B (C. elegans)
  Uniprot ID: O14795
  ENST ID: ENST00000378495
  CDS Start-End: 223-4998
cccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 198128 - DNA, 5063 bp, Homo sapiens
  Payload ID: 19086
  Gene Name: unc-13 homolog B (C. elegans)
  ENST ID: ENST00000378496
  CDS Start-End: 1449-5042
cagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagaagaaaagcgaggagcccttcagattccagatgatggtgacccctctctgcctcagtggctcccggaagggccagccggagggctctatggcattgacagcatgccagatttacgcagaaagaagccactgccacttgtcagtgatctggtgaagtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagtgcatgatgggaaaggtattagatttactgctaatgaggacattcgtccggaaaaggggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgcca

SEQ ID NO: 198129 - DNA, 5293 bp, Homo sapiens
  Payload ID: 19086
  Gene Name: unc-13 homolog B (C. elegans)
  ENST ID: ENST00000396787
  CDS Start-End: 283-5151
gggagggagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttgtcactggacctatttgggctggggagaacaacagacttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagtgcatgatgggaaaggtattagatttactgctaatgaggacattcgtccggaaaaggggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttgggg

SEQ ID NO: 198130 - DNA, 6426 bp, Homo sapiens
  Payload ID: 19086
  Gene Name: unc-13 homolog B (C. elegans)
  Uniprot ID: O14795
  ENST ID: ENST00000619578
  CDS Start-End: 293-5125
gtggaatgacgggagggagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagtgcatgatgggaaaggtattagatttactgctaatgaggacattcgtccggaaaaggggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagc

SEQ ID NO: 198131 - DNA, 6432 bp, Homo sapiens
  Payload ID: 19086
  Gene Name: unc-13 homolog B (C. elegans)
  ENST ID: ENST00000617908
  CDS Start-End: 1538-5131
gtggaatgacgggagggagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctggctatgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagtgcatgatgggaaaggtattagatttactgctaatgaggacattcgtccggaaaaggggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagc

SEQ ID NO: 198132 - DNA, 569 bp, Homo sapiens
  Payload ID: 19086
  Gene Name: unc-13 homolog B (C. elegans)
  ENST ID: ENST00000481299
  CDS Start-End: 1-569
tggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggaaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccct

SEQ ID NO: 198133 - DNA, 5063 bp, Homo sapiens
  Payload ID: 19086
  Gene Name: unc-13 homolog B (C. elegans)
  ENST ID: ENST00000634487
  CDS Start-End: 181-1578
cagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagaagaaaagcgaggagcccttcagattccagatgatggtgacccctctctgcctcagtggctcccggaagggccagccggagggctctatggcattgacagcatgccagatttacgcagaaagaagccactgccacttgtcagtgatctggctatgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagtgcatgatgggaaaggtattagatttactgctaatgaggacattcgtccggaaaaggggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgcca

SEQ ID NO: 198134 - DNA, 12946 bp, Homo sapiens
  Payload ID: 19087
  Gene Name: unc-13 homolog C (C. elegans)
  Uniprot ID: Q8NB66
  ENST ID: ENST00000260323
  CDS Start-End: 1-6645
atggtggctaattttttcaagagcttgattttaccttacattcataagctttgcaaaggaatgtttacaaagaaattgggaaatacaaacaaaaacaaagagtatcgtcagcagaaaaaggatcaagacttccccactgctggccagaccaaatcccccaaattttcttacacttttaaaagcactgtaaagaagattgcaaagtgttcatccactcacaacttatccactgaggaagacgaggccagtaaagagttttccctctcaccaacattcagttaccgagtagctattgccaatggcctacaaaagaatgctaaagtaaccaacagtgataatgaggatctgcttcaagagctctcttcaatcgagagttcctactcagaatcattaaatgaactaaggagtagcacagaaaaccaggcacaatcaacacacacaatgccagttagacgcaacagaaagagttcaagcagccttgcaccctctgagggcagctctgacggggagcgtactctacatggcttaaaactgggagctttacgaaaactgagaaaatggaaaaagagtcaagaatgtgtctcctcagactcagagttaagcaccatgaaaaaatcctggggaataagaagtaagtctttggacagaactgtccgaaacccaaagacaaatgccctggagccagggttcagttcctctggctgcattagccaaacacatgatgtcatggaaatgatctttaaggaacttcagggaataagtcagattgaaacagaactttctgaactacgagggcacgtcaatgctctcaagcactccatcgatgagatctccagcagtgtggaggttgtacaaagtgaaattgagcagttgcgcacagggtttgtccagtctcggagggaaactagagacatccatgattatattaagcacttaggtcatatgggtagcaaggcaagcctgagatttttaaatgtgactgaagaaagatttgaatatgttgaaagcgtggtgtaccaaattctaatagataaaatgggtttttcagatgcaccaaatgctattaaaattgaatttgctcagaggataggacaccagagagactgcccaaatgcaaagcctcgacccatacttgtgtactttgaaacccctcaacaaagggattctgtcttaaaaaagtcatataaactcaaaggaacaggcattggaatctcaacagatattctaactcatgacatcagagaaagaaaagagaaagggataccatcctcccagacatatgagagcatggctataaagttgtctactccagagccaaaaatcaagaagaacaattggcagtcacctgatgacagtgatgaagatcttgaatctgacctcaatagaaacagttacgctgtgctttccaagtcagagcttctaacaaagggaagtacttccaagccaagctcaaaatcacacagtgctagatccaagaataaaactgctaatagcagcagaatttcaaataaatcagattatgataaaatctcctcacagttgccagaatcagatatcttggaaaagcaaaccacaacccattatgcagatgcaacacctctctggcactcacagagtgattttttcactgctaaacttagtcgttctgaatcagatttttccaaattgtgtcagtcttactcagaagatttttcagaaaatcagtttttcactagaactaatggaagctctctcctgtcatcttcggaccgggagctatggcagaggaaacaggaaggaacagcgaccctgtatgacagtcccaaggaccagcatttgaatggaggtgttcagggtatccaagggcagactgaaactgaaaacacagaaactgtggatagtggaatgagtaatggcatggtgtgtgcatctggagaccggagtcattacagtgattctcagctctctttacatgaggatctttctccatggaaggaatggaatcaaggagctgatttaggcttggattcatccacccaggaaggttttgattatgaaacaaacagtctttttgaccaacagcttgatgtttacaataaagacctagaatacttgggaaagtgccacagtgatcttcaagatgactcagagagctacgacttaactcaagatgacaattcttctccatgccctggcttggataatgaaccacaaggccagtgggttggccaatatgattcttatcagggagctaattctaatgagctataccaaaatcaaaaccagttgtccatgatgtatcgaagtcaaagtgaattgcaaagtgatgattcagaggatgccccacccaaatcatggcatagtcgattaagcattgacctttctgataagactttcagcttcccaaaatttggatctacactgcagagggctaaatcagccttggaagtagtatggaacaaaagcacacagagtctgagtgggtatgaggacagtggctcttcattaatggggagatttcggacattatctcaatcaactgcaaatgagtcaagtaccacacttgactctgatgtctacacggagccctattactataaagcagaggatgaggaagattatactgaaccagtggctgacaatgaaacagattatgttgaagtcatggaacaagtccttgctaaactagaaaacaggactagtattactgaaacagatgaacaaatgcaagcatatgatcacctttcatatgaaacaccttatgaaaccccacaagatgagggttatgatggtccagcagatgatatggttagtgaagaggggttagaacccttaaatgaaacatcagctgagatggaaataagagaagatgaaaaccaaaacattcctgaacagccagtggagatcacaaagccaaagagaattcgtccttctttcaaagaagcagctttaagggcctataaaaagcaaatggcagagttggaagagaagatcttggctggagatagcagttctgtggatgaaaaggctcgaatagtaagtggcaatgatttggatgcttccaaattttctgcactccaggtgtgtggtggggctggaggtggactttatggtattgacagcatgccggatcttcgcagaaaaaaaactttgcctattgtccgagatgtggccatgaccctggctgcccggaaatctggactctccctggctatggtgattaggacatccctaaataatgaggaactgaaaatgcacgtcttcaagaagaccttgcaggcactgatctaccctatgtcttctaccatcccacacaattttgaggtctggacggctaccacacccacctactgttatgagtgtgaagggctcctgtggggcattgcaaggcaaggcatgaagtgtctggagtgtggagtgaaatgccacgaaaagtgtcaggacctgctaaacgctgactgcttgcagagagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacagtggtttctgcacagggtctacaggcaaaagataaaacagggtctagtgatccatatgttacagttcaagttggaaagaacaaaagaagaacaaaaaccatttttggaaatttgaatccagtatgggatgagaagttttattttgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttagagaaaaggacagataagtcagctgtatctggggccatacgattgaaaatcaatgtggagataaaaggagaagagaaggttgctccatatcatattcaatatacatgtttacatgagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtagggaaaaattcataaaactactggaccagttacataactctttgaggattgatctgtcaaagtatagggaaaactttcctgcaagcaatactgaaagactgcaagacctgaaatcaactgttgacctgttaacaagtatcaccttttttaggatgaaggttctggagctgcaaagccccccaaaagcgagcatggtggtgaaggactgtgtaagggcttgcctggattctacatacaagtatatttttgacaactgccatgaactctactcccagctaacagacccgagtaagaaacaggatattcctcgtgaagatcagggaccaaccaccaagaatttggatttttggccccaacttattacactgatggttactattattgatgaggataaaactgcctacacacctgtcctgaatcagtttcctcaagagctgaacatgggaaaaataagtgccgaaattatgtggactctttttgctctggatatgaaatatgcattagaagaacatgaaaatcagcggttatgcaagagcaccgattatatgaatttgcatttcaaagttaaatggttttataatgaatatgtgcgtgaacttcctgccttcaaggatgctgttcctgaatactccttgtggtttgaaccttttgtcatgcaatggctagatgaaaacgaagatgtgtcaatggaattccttcatggagcactgggaagagacaaaaaagatggattccagcagacatctgagcatgctctcttttcttgctccgtggttgatgtctttgctcagctgaatcagagctttgaaattattaagaaactggaatgccctaatcctgaagcattatctcacttaatgagaagatttgcaaagactatcaataaagtgctgctccagtatgctgcaattgtatcaagtgatttcagttcacattgtgataaggaaaatgtgccctgtatcttgatgaacaatattcaacaattgcgggtccagctggaaaaaatgtttgaatccatgggagggaaggagctagattctgaagctagtactattctaaaagaacttcaggttaagctcagtggggtcctggatgagctcagcgtcacttatggtgaaagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttcttcctcctctgacagatcaaacaggaccccagatgattttcattgcagctaaagatcttggacaattatccaaactgaaggagcacatgattcgagaggatgccaggggtctgacgccaagacaatgcgctataatggaggtagtcctggctaccatcaagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgcagcattgtattgtatcttctgcctttttatttcatttatgcaatatcatctcatttaggaataaaaactccaggctcttttgaccatatgtaatagtcttcatattatttggttctaacatctcattaaaagtttagatgtcagaatggttattattaaaaagtcaaaaaataacagatgctggcgaggttgtgaagaaaaatgtttgtttgtttatacactgctggtgggagtgtaaattacttcaattattgtagaaagcagtgtggtgattcctcaaagacctacaaacagaattaccattcgactaagcaatcccattactgagtacacagccaaaggaatatcaaacaaacattctaccataaacacatatgcacgtatatgtccactgcagcactattcacaatagcaaacacatggaaccatcctaaatgcccatcaacagtagaccagataaagaaaatgtggtacatatacaccgtggaatactatgcaggcataaaaagaatgagaccatgtccttcacagtgacatggatggagctggaggccattacctgaagcaaactaacacaggaatagaaaacgaaatactacatgtttgttatcacaagtggaagctaaacgatgaggacacatggacactaagggggcaacaacagacactgtggcctacttgagggtaggaggagggaaaagataagaaaaagtatctgtcacgctacgaagcttactacctgggtgacaaaataatctacaccaaaacccccgtgacacacaatttacctacgtaataaacctggacatgaacccctgaatctaaaataaaagtttttaaaaaaaagttcagatgttaaaattcattccacaggtggtgtgttcatggaaaccactgtatattgtaatgacgaggaaaataaggatgaactaatgtatctacctatatattgctaaataccgtttagtcccatgaacaaaattcaacatgcaacatggttaaaaatctcacatgataaaagttttcatcaattacttgaaaaattcattctagatttatgttataaatattttacagaacattgacttaagctctttaggagcacatattaatgtcataatacatgatacatttgagtaaaaggcagttaggatttgcattgatcactttaaattgagcaaggtattttttccctgacatgtttaattgcatccaattattctgtcttttacaatgtatacaatatatatcaaagcctaatagtggcagggtgaattaagtctatttatgactatcataaagtacaggtactaattttgaaatgattataaattctgtagactctgttttcctctcaaagcacaagtattcccgttgtcttcagaacaaagcctgttatatttacttacccaaattagtagtcactctaaggttcccagtgatctctgtcaattgagtgttgcactaatgtgtgtagcaatttattcatcttattctagataaaacacacaaaggcaaagctctgttgcttgtctatggataaacctcacattacaggtctttaaagatacacgtgtaaatcaaatttagcaaacacaaagtatttaaacccagagtggagtatttgctattcgaaggaatttgaatgcattaagtaatcagatgtccccactacaacctgcgctaatttatctacttctaggataatttataacttgaatttatcttaaatgaggcacatttataaatgacaattctaacttaatgtcttttatttggtcttttttaaaaacaatgcgtgaaacaagattttctccttttaatttctctacattacataaagatatgactatactagctagcccctttatggactactatagcagctttaatctttatgctcaaataataaatgatcatacttatacatgactcagggaatatccttgaataaatgtctaattccacctacttagaaaaattcttgggcacacaggcaagagactgccctcccctgtggaatgaattttaactcccctgatgttacctgtgtttatactcaagtcctttgtttgaaatagttgcccctttgctcttttgactccccaggcctccactgatcactcttctctgtggttcaggcttctgcagtgtgatttttagaataaaaaactaggatatgtgatatgaaggagaatcaattccaatttgcgaatgttaaataatatatatttaaaagtgctcatgttttttcacatcatgacaactttgaaatcaggatacatatataatcctttggcatgttatggtttaattggtgatttttttctcccttattagtacatgtttcttcttataatgaatgacttccaggcatcaataagcatatttattaaaaagtatatataaatcgatgaaaataaagtaatgcttagttgtctattttaaaacatagtttggctaggcacagtggctcacaactgtaatcccagcacactgagaggccgagacaggcaggttgctttgagcttagaagttcgagaccagcctagtcaacgtggcaaagccccatctctacaaaaaaatacaaaaatgagtcaggcctggtggcatgtgactgtagtcccagctacttgagaggctgaggcaggagaatcacttgagcctgggaagcagaggttccagtgagccaagatgcatcactgcactccagcctgggcaacagaatgagaccctgtctcaaaaaatatgcatattttttaatttgcatatactaaaattctctcttttggcatacatttctgtgttatgacaaatgcgtagtcatgtattaatcacaacagtcaagatatgggacaattccctcatacctcaaaattccacgttaccactttatagacaaacacttttcctactatcaaccctctgcagcactggttcattttagtccctcacgttttgtgtattccagaatgtcatataaacggaactatacagtatatattcttttgagcctgtataatttcacttagcacaatgcaccagagattcatctacattgtggcatgtataaattattacctagttttttttgttgaatagtactgcactgtatgaacattaaaaagatttcattcaccacttactacacttaccttgtttggcaatattatgaacaaagcttttataaacattcacatacaggattttgtgtatacttgtttttatttttcttgggtgattatctattagagtgtgatttctaggtcttatgataagtatatctttaacttcataaggaactttcaaacttttttgaaagtagttgtaaaattttacatttccagaagcaatgtatgagagtttcagttgctctgcatctttgcaagcactgggtatcgtcagttctttattttagttcttcttctgatatacacaaaatagcatctcaacatgcctttaatttgtattcatctgaggactaataacattgagtatctctgtgtgtgcttatttgacatccatatattttgtttagtgaagtatctgcaaatcttttgcccatttatttaatgagttgtttattgttgagtttggggacatattttcatattccatatacaaaccctttgtcagatatgaaatgtgcaactatttcatcccagtccgtggctagtcttttcatttttataacaacctctttaagagaacaaaaggttttcacttccatcaagtcgaatttgatgaaatcattttttctcttttatagatcatagctttgctaccataagaattacttgcctcactcaaggccaaaaagatttttttctcctatgttttcatatggaaattttatactttggggtattacaatttggcctatgaaccgttttgaggttaatagagggtgtaaagtttgagttaaggttcatctataattattaaattacaattgagtaattaattagaaactaattttcataggcatgtccaattgttccagcaccacacaattcattgaaaatactacagttatcacttggaattacctttgtaccttcatcataaatcaattgaccaaatgtgtgtgagtccatttctgacatctctagtctgttccattgatctgactctataccttatcaccaatgtgacactgtagcaattactgtagctttatactgtcttgaactcaggtagtaagagttctccatgttcttctcttcaaaacagtggagtattctactacttctcactctctataaaaattttaacagccagccaggcacggtggctcacgcctgtagtcccagcactttgggaggtcaaggcaggcagatcacctgaggtcaggagttcaagaccagcctaaccaacatggagaaaccccgactctactaaaaatacaaaattagccagacatggtggcgcatgcctgtaatcccagctactctggaggctgaggcaggggaatcacttgaacccaggagacggaggctgcagtgagacgagatcacgccattgcactccaacctgggcaacaagagcaaaactctgtctcaaaaaaaaaaataacagcctactgggattttgactgagaacttattaaatccatacaccaatttacaaacaaccgatgtcttaacaatattgaatcttcaattcgtgggcacagtatatgtctccacttatttacatcttcattgatttattactgtcttatggttttcagcatacaaatcctaccaaggatttcttctgtatgtgtacaagagtataaatgttactttgagaataaaattcaaaatcc

SEQ ID NO: 198135 - DNA, 938 bp, Homo sapiens
  Payload ID: 19087
  Gene Name: unc-13 homolog C (C. elegans)
  ENST ID: ENST00000539562
  CDS Start-End: 235-642
cagtgactcactcacatgctcacaaattcagcaatttgttcatgatagctgcttggcggggtggataatatcctggtcaaaatgactgagccacatcagtgatgtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaacta

SEQ ID NO: 198136 - DNA, 535 bp, Homo sapiens
  Payload ID: 19087
  Gene Name: unc-13 homolog C (C. elegans)
  ENST ID: ENST00000559093
  CDS Start-End: 1-535
ttgcaaagactatcaataaagtgctgctccagtatgctgcaattgtatcaagtgatttcagttcacattgtgataaggaaaatgtgccctgtatcttgatgaacaatattcaacaattgcgggtccagctggaaaaaatgtttgaatccatgggagggaaggagaagaaggaaggagaaagattcttttatgagctagattctgaagctagtactattctaaaagaacttcaggttaagctcagtggggtcctggatgagctcagcgtcacttatggtgaaagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttct

SEQ ID NO: 198137 - DNA, 362 bp, Homo sapiens
  Payload ID: 19087
  Gene Name: unc-13 homolog C (C. elegans)
  ENST ID: ENST00000560537
  CDS Start-End: 302-362
gaaatctgattaagataacacctaaagaagagaaggtccatccataggttggctgagttcttatttctgaaataatctctggaggaacttttaagaatcctgaaagattcaactattttaaactcttctggaaaagtatatgcatatactcctttgaaaccgctatgattgtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaa

SEQ ID NO: 198138 - DNA, 4393 bp, Homo sapiens
  Payload ID: 19088
  Gene Name: unc-13 homolog D (C. elegans)
  Uniprot ID: Q70J99
  ENST ID: ENST00000207549
  CDS Start-End: 381-3653
gttcagcccagcctgggcacagcacatggatggggcaggatgctgcccgcctgttctgggcccccccgccccctgctgagagcgttgtccccttcccagggcctctgtaggagggtggggcggggccaggcctgcccacggggtccaccttctgctccagccagaggagggtcctgtagggatcccagctggggaaggtgcagggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgcctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctcttaaaa

SEQ ID NO: 198139 - DNA, 3648 bp, Homo sapiens
  Payload ID: 19088
  Gene Name: unc-13 homolog D (C. elegans)
  Uniprot ID: Q70J99
  ENST ID: ENST00000412096
  CDS Start-End: 14-3442
agagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgcctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagc

SEQ ID NO: 198140 - DNA, 575 bp, Homo sapiens
  Payload ID: 19088
  Gene Name: unc-13 homolog D (C. elegans)
  ENST ID: ENST00000586108
  CDS Start-End: 67-575
ggagggtcctgtagggatcccagctggggaagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagac

SEQ ID NO: 198141 - DNA, 403 bp, Homo sapiens
  Payload ID: 19088
  Gene Name: unc-13 homolog D (C. elegans)
  ENST ID: ENST00000586519
  CDS Start-End: 1-207
tcctaccgcgcctctgagcagaagctgcgtgtggagctgctcagcgcctccagcctgctgcccctggactccaatgcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagag

SEQ ID NO: 198142 - DNA, 776 bp, Homo sapiens
  Payload ID: 19088
  Gene Name: unc-13 homolog D (C. elegans)
  ENST ID: ENST00000587105
  CDS Start-End: 1-443
ggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgg

SEQ ID NO: 198143 - DNA, 589 bp, Homo sapiens
  Payload ID: 19088
  Gene Name: unc-13 homolog D (C. elegans)
  ENST ID: ENST00000586147
  CDS Start-End: 24-589
agggaagggcagagaaggccaccatggcgacactcctctcccatccgcagcagcgccctcccttcttgcgccaggccatcaagataaggcgccgcagagtcagagatctacaggatcccccgccccaaatggccccggagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgca

SEQ ID NO: 198144 - DNA, 668 bp, Homo sapiens
  Payload ID: 19088
  Gene Name: unc-13 homolog D (C. elegans)
  ENST ID: ENST00000589670
  CDS Start-End: 1-439
cagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctcttaaaa

SEQ ID NO: 198145 - DNA, 930 bp, Homo sapiens
  Payload ID: 19088
  Gene Name: unc-13 homolog D (C. elegans)
  ENST ID: ENST00000592386
  CDS Start-End: 1-930
gcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgag

SEQ ID NO: 198146 - DNA, 848 bp, Homo sapiens
  Payload ID: 19088
  Gene Name: unc-13 homolog D (C. elegans)
  ENST ID: ENST00000590762
  CDS Start-End: 48-848
gagggaggtggggtgcgggtgcggagggctcgcgctgctgggcacccatggacctcagccacggcgggcccagggacggacctccaggaggcctgctgggggaacagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcgg

SEQ ID NO: 198147 - DNA, 4002 bp, Homo sapiens
  Payload ID: 19089
  Gene Name: unc-45 myosin chaperone A
  Uniprot ID: Q9H3U1
  ENST ID: ENST00000394275
  CDS Start-End: 836-3625
acttaacaaccgaagtaacccgcaatgcggaagggcgaggggattgcgagtcaccgagtttcccgcgcggcttgagtcacggcctagaaagagagatgttggggttcccaggaccaggacagaggtggtagtgaactctcatgggcatccagagaaggtcaggccccttgctgacaggcctatctgtggggctactgctgctcttcagctgggtgacccttgtccagccaacctctctctcagctctggtccaccaccctcacttgtgccagaccacccgggatgtccatggccgtcactaccctggtttcttttgccctcgtctgtctgattctccagaggaagcctactgctgccacctgcaggctgcagggggctcctgctgcacccgggctgaatttgaggccctgtaccaagtcaatctgtccgctcttccgcccccgcccatcctcaggggcccaggcccgctcctagtgctgggcctctacaacctactggttgtgaccctgatgaccgtagacctcgtgcacttctgctgcggtcggggccggagtctgggctggagccaccgcaggcctccctctgggtcctccgccgcgagctccctgcaggtctctgcggggacagcttaggtgcgcccggagcttgcctgcacctgcgatccagagccaagcgccccgcccctgcccgggcgcgctccctccttagccctgcccctctctgaccccacctccgacgcaagagtggggcggggcagctgccggtggcgtcccgaacccagactcgccccgccccagagactgcgcctgcgcgggcacgagacaacctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 198148 - DNA, 3252 bp, Homo sapiens
  Payload ID: 19089
  Gene Name: unc-45 myosin chaperone A
  Uniprot ID: Q9H3U1
  ENST ID: ENST00000418476
  CDS Start-End: 41-2875
agagactgcgcctgcgcgggcacgagacaacctctccgcgatgactgtgagtggtccagggacccccgagccccggccggccacccccggggccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 198149 - DNA, 5679 bp, Homo sapiens
  Payload ID: 19090
  Gene Name: unc-45 myosin chaperone B
  Uniprot ID: Q8IWX7
  ENST ID: ENST00000268876
  CDS Start-End: 98-2893
agactgaggctggctggctggaggttgacacaggagtgctcaggggagcagcatcacaagagggcagatcgaaagcatcgtccttgctgaaaaacagatggcagaggtggaagcggtacagctgaaggaggaaggaaaccggcatttccagctccaggactacaaggccgccacaaatagctacagccaggccctgaagctgaccaaggacaaggccctgctggccacgctttatcggaaccgggcagcctgtggcctgaaaacggagagctacgtccaggcagcttcagatgcctccagagccatcgacatcaactcctcggacatcaaggctctgtatcggcgatgccaggcactggagcacctggggaagctggaccaggccttcaaagacgtgcagcgttgtgccaccctcgagccacggaaccagaacttccaggagatgctgaggagactcaacaccagcattcaggagaagctccgagtgcagttctccacagactcgagggtacagaagatgtttgagatcctcttggatgaaaacagtgaggctgataagcgggaaaaggctgccaacaatctcattgtcctaggccgtgaggaagcaggggctgagaagatcttccagaacaatggagtagccttgctactgcagcttctggacactaagaagcctgagctggtgctggctgcagtgcggaccctgtcgggcatgtgcagcggccaccaagccagagccacagtgattctgcatgcagtgcggatagaccgaatctgtagcctcatggccgtggagaatgaggagatgtctctggctgtctgcaacctgctccaagccatcattgactccttgtctggggaggacaagcgggagcatcgagggaaggaggaggccctggttctagacaccaagaaggacctgaagcagatcaccagccacctgctggacatgctagtcagcaagaaggtgtctggccagggcagggatcaggcgctgaacctgctcaataagaatgttcccaggaaggaccttgccattcatgacaactcacgtaccatctatgtggtggataatggtctgaggaagatcctgaaggttgtggggcaggttccagatctgccatcctgcctgcccctgactgacaacacccgcatgctggcctctatcctcatcaacaagctctatgatgacctgcgctgtgacccggagcgcgatcacttccgcaagatctgtgaggaatatatcacgggcaagtttgacccccaggacatggacaagaacttgaatgccatccagacagtgtcagggatcctgcagggcccctttgacctgggcaaccagctgctgggactgaaaggtgtgatggagatgatggtggcactatgtggctcagagcgcgagacggaccagctggtggccgtggaggccctcatccatgcctccacgaagctcagccgcgccaccttcatcatcaccaatggagtgtcactgctcaaacagatctacaagaccaccaaaaatgagaagatcaagatccgcacactggtgggactctgtaagctcggctctgcaggtggcacagactacggtctcaggcagtttgcggaagggtcgacagaaaaactggccaaacagtgtcgcaagtggctgtgcaatatgtccatagacactcggacccgacgctgggcagtggagggcctggcctacctcacgctggacgctgatgtgaaggacgactttgtccaggacgtccctgccctgcaggccatgtttgagctggccaaggcaggtaccagtgacaagaccatcctgtactcggtggccaccaccctggtgaactgcaccaacagctacgatgtcaaggaggtcatcccagagcttgtccagctcgccaagttctccaagcagcatgtgcccgaggaacaccccaaggacaagaaggactttatagacatgcgggtgaagcggcttctgaaggcgggtgtcatctctgccctggcttgcatggtgaaagcagatagtgccatcctcactgaccagaccaaggagctgctggccagggtattcctggcactgtgtgacaacccaaaggaccgaggcaccattgtggctcaaggtggtggcaaggccctgattcccctggctttggagggcacagatgtgggcaaggtgaaggcagcccacgctctagcaaagatcgctgctgtctccaatccggacattgcttttcctggggagcgggtgtatgaggtggtgcggccccttgtaagactcttggacacacagagggatgggcttcagaactatgaggctctcctaggcctcaccaacctgtctgggcggagtgacaaactccggcagaagatctttaaggagagggccttgccagacatcgagaactacatgtttgagaatcatgatcagctgcggcaggcggccaccgagtgcatgtgcaacatggtgctccacaaggaggtacaggaaaggttcttggctgacgggaatgaccggctgaagctggtggtgctgctctgcggggaggatgatgataaggtgcagaatgcggctgcaggggctctggccatgctgacagcagcacacaagaaactgtgcctcaagatgactcaagtgacaacccagtggttggagatcctccagcggctttgcctgcacgaccagctgtctgtccaacaccggggcctggtcattgcctacaacctactggcagccgatgctgagctggccaagaagctggtggagagtgagctgctggagatcctgactgtggtgggcaaacaggagccagatgagaagaaggcagaagtggttcagacagcccgagaatgtctcatcaagtgcatggattatggtttcattaaaccagtgtcttagacagcgaccctcagggatgctgggagtggtcctgtactgtgcagagtcctgggttggttgggttctcctgaagagtcaggtcatctagggatcatagcagtgacaatgaagtctcaatataaaggaaagacttgattgttctctgagttgtgagtcttctcctttgtcctgacagagtttggatgtttcactctctctcttgcttcctgtctccttatatttgtcatgtttcagaaattcccagaataattttcacccatgattagaaataggttggatcattctttctgtacccattctgaaggccaggataataggttgaagttctttatattttggaaaatggattttgtggtaaggtaggaactaacgggtgtgtgcatataaaggttaatgctgttgtatttggatgctgatctgtgctgttttcatgacctctctcccacactatttgaatcagtctgttcagaactgtgtgtttcacctgcagtgctctgtcccagtcccatgcccattcccatcacttcactgtgatggaaatagagtttatgttcaacagtggggcatgacctctgcaatttgcttgggaaagtcttccaagcaagatggacatgatgaatacaaataagatctactcaaagtacttcaaacaaaaaataaataattcattggctcatgtatcttggccacccagggaaggtctgacattgttagttagatccagagtttcaaatgtcatcaccatggatgtgtctttttctctctctcatttcccctccccatatcttgtcttttatttattataggtttgtctcattccctggcaggctctctccctgtgataggaaagagagtccccagcagccccagggtgacatagttgttatagttcattatggaatagaagagagaagagcattctcaataacccggcaaagttcccagggatgactctgatatgtctatgtctcaggtcacatttccatctatgaaccaatcatattcagaggtggaatgctaattggccaggcctgggtcatatatacaagtctagggaagaaatgagcttcatccctgtccaattgacatggactgattaggggtattaatggaagaggtgtgccaccacaaaagaatgtaccctgggcagatcaaagaacatattctgtatgtcaggcttggccacaaaagaatgacacaagtaatatgctgtagatcagaacctctctgctaatattgcctttttagcatggttaagatagctaagatctagtactgtcactccagtatgtcccaattctacctacgtttattgaagggtcaacagttctgatctcagcattgggtaaagggtgggacattcagatttacggtccttgataaaaacaatttacaacgttccgttgtgtaataaatgtaagtgtacatatgcctgggacatcagctggaaaagggacagactatcagagagttgcactgttgcggtatgggccaaatccaacataatacccgctgtacctctagagaactaaaaccttaatttctcagatcttttctgcactaatggtctttacatacagcctacattttaactaactcttgcatgggcttgtttcacagcaggaaactatattcatcatatccttattatgatagagaatgacaacattcaaaagggtgtggtgcttctgaaaatatacacaataaatggcatgatttgacctctgtcaaattcttctttcctgctttcctcatatgtgggcttgagtgggtgtatttagctcctttaaaggaaactctttcacaggcagggccacactcttactcgttttgatctcatgaggttacatctgccagtggcgttcagggccagttagataaagttcatcttgtttggattggagagactttttttttttttttttttgagacagggtcttgctctgtaacctaggctcaagtgcagtgcagtggtgcagtcatggctcaccgcagccttggtctcctgggctcaagtgatctttctacttcagcctcctcaatagctgggactacaggcacacaccaccacccccaggtaattaaaaaatttttttttgtagagacagggtctcactatgttgcccagtctgggagaccacattctttaacatgaatattttgtaaatagtccaagaagatctagaggaaagctgaattccttcatctgatttttgccactgggctgcctcccattgtctggctaagtcttcatgggaggcctttaagaaaagctgtgacaaatacctttgtttcccactgcctaggttacataagtagttggcttttccagcctagactcttatattgttgcttgtaagagggcccttctttgcagatttcttttttttttcatctatgctttcaaataggcagatgctagcctgagatcatctctttattgaggtagtttgcccaaaaacagcaaggaacagccaatacctgccaactttctaggtttttccaaccaattctcttacagaaaatctataaatatcttagaggtatgtttcttagtttcccaacatataatgggaaaattcatcatttatattattacttttaactgaagtatgttgttatcagagaacttggtctgtgtcatattaatcctttgccatttgagaagcatacagttttaaagtttatatctccaaaaggatattttgtaaaaatttaacccctttgactcttagtcttctcatttgtgaaaggtaaataataaagaatttctgttcctagtaaga

SEQ ID NO: 198150 - DNA, 5638 bp, Homo sapiens
  Payload ID: 19090
  Gene Name: unc-45 myosin chaperone B
  Uniprot ID: Q8IWX7
  ENST ID: ENST00000394570
  CDS Start-End: 71-2860
ttgacacaggagtgctcaggggagcagcatcacaagagggcagatcgaaagcatcgtccttgctgaaaaaatggcagaggtggaagcggtacagctgaaggaggaaggaaaccggcatttccagctccaggactacaaggccgccacaaatagctacagccaggccctgaagctgaccaaggacaaggccctgctggccacgctttatcggaaccgggcagcctgtggcctgaaaacggagagctacgtccaggcagcttcagatgcctccagagccatcgacatcaactcctcggacatcaaggctctgtatcggcgatgccaggcactggagcacctggggaagctggaccaggccttcaaagacgtgcagcgttgtgccaccctcgagccacggaaccagaacttccaggagatgctgaggagactcaacaccagcattcaggagaagctccgagtgcagttctccacagactcgagggtacagaagatgtttgagatcctcttggatgaaaacagtgaggctgataagcgggaaaaggctgccaacaatctcattgtcctaggccgtgaggaagcaggggctgagaagatcttccagaacaatggagtagccttgctactgcagcttctggacactaagaagcctgagctggtgctggctgcagtgcggaccctgtcgggcatgtgcagcggccaccaagccagagccacagtgattctgcatgcagtgcggatagaccgaatctgtagcctcatggccgtggagaatgaggagatgtctctggctgtctgcaacctgctccaagccatcattgactccttgtctggggaggacaagcgggagcatcgagggaaggaggaggccctggttctagacaccaagaaggacctgaagcagatcaccagccacctgctggacatgctagtcagcaagaaggtgtctggccagggcagggatcaggcgctgaacctgctcaataagaatgttcccaggaaggaccttgccattcatgacaactcacgtaccatctatgtggtggataatggtctgaggaagatcctgaaggttgtggggcaggttccagatctgccatcctgcctgcccctgactgacaacacccgcatgctggcctctatcctcatcaacaagctctatgatgacctgcgctgtgacccggagcgcgatcacttccgcaagatctgtgaggaatatatcacgggcaagtttgacccccaggacatggacaagaacttgaatgccatccagacagtgtcagggatcctgcagggcccctttgacctgggcaaccagctgctgggactgaaaggtgtgatggagatgatggtggcactatgtggctcagagcgcgagacggaccagctggtggccgtggaggccctcatccatgcctccacgaagctcagccgcgccaccttcatcatcaccaatggagtgtcactgctcaaacagatctacaagaccaccaaaaatgagaagatcaagatccgcacactggtgggactctgtaagctcggctctgcaggtggcacagactacggtctcaggcagtttgcggaagggtcgacagaaaaactggccaaacagtgtcgcaagtggctgtgcaatatgtccatagacactcggacccgacgctgggcagtggagggcctggcctacctcacgctggacgctgatgtgaaggacgactttgtccaggacgtccctgccctgcaggccatgtttgagctggccaagaccagtgacaagaccatcctgtactcggtggccaccaccctggtgaactgcaccaacagctacgatgtcaaggaggtcatcccagagcttgtccagctcgccaagttctccaagcagcatgtgcccgaggaacaccccaaggacaagaaggactttatagacatgcgggtgaagcggcttctgaaggcgggtgtcatctctgccctggcttgcatggtgaaagcagatagtgccatcctcactgaccagaccaaggagctgctggccagggtattcctggcactgtgtgacaacccaaaggaccgaggcaccattgtggctcaaggtggtggcaaggccctgattcccctggctttggagggcacagatgtgggcaaggtgaaggcagcccacgctctagcaaagatcgctgctgtctccaatccggacattgcttttcctggggagcgggtgtatgaggtggtgcggccccttgtaagactcttggacacacagagggatgggcttcagaactatgaggctctcctaggcctcaccaacctgtctgggcggagtgacaaactccggcagaagatctttaaggagagggccttgccagacatcgagaactacatgtttgagaatcatgatcagctgcggcaggcggccaccgagtgcatgtgcaacatggtgctccacaaggaggtacaggaaaggttcttggctgacgggaatgaccggctgaagctggtggtgctgctctgcggggaggatgatgataaggtgcagaatgcggctgcaggggctctggccatgctgacagcagcacacaagaaactgtgcctcaagatgactcaagtgacaacccagtggttggagatcctccagcggctttgcctgcacgaccagctgtctgtccaacaccggggcctggtcattgcctacaacctactggcagccgatgctgagctggccaagaagctggtggagagtgagctgctggagatcctgactgtggtgggcaaacaggagccagatgagaagaaggcagaagtggttcagacagcccgagaatgtctcatcaagtgcatggattatggtttcattaaaccagtgtcttagacagcgaccctcagggatgctgggagtggtcctgtactgtgcagagtcctgggttggttgggttctcctgaagagtcaggtcatctagggatcatagcagtgacaatgaagtctcaatataaaggaaagacttgattgttctctgagttgtgagtcttctcctttgtcctgacagagtttggatgtttcactctctctcttgcttcctgtctccttatatttgtcatgtttcagaaattcccagaataattttcacccatgattagaaataggttggatcattctttctgtacccattctgaaggccaggataataggttgaagttctttatattttggaaaatggattttgtggtaaggtaggaactaacgggtgtgtgcatataaaggttaatgctgttgtatttggatgctgatctgtgctgttttcatgacctctctcccacactatttgaatcagtctgttcagaactgtgtgtttcacctgcagtgctctgtcccagtcccatgcccattcccatcacttcactgtgatggaaatagagtttatgttcaacagtggggcatgacctctgcaatttgcttgggaaagtcttccaagcaagatggacatgatgaatacaaataagatctactcaaagtacttcaaacaaaaaataaataattcattggctcatgtatcttggccacccagggaaggtctgacattgttagttagatccagagtttcaaatgtcatcaccatggatgtgtctttttctctctctcatttcccctccccatatcttgtcttttatttattataggtttgtctcattccctggcaggctctctccctgtgataggaaagagagtccccagcagccccagggtgacatagttgttatagttcattatggaatagaagagagaagagcattctcaataacccggcaaagttcccagggatgactctgatatgtctatgtctcaggtcacatttccatctatgaaccaatcatattcagaggtggaatgctaattggccaggcctgggtcatatatacaagtctagggaagaaatgagcttcatccctgtccaattgacatggactgattaggggtattaatggaagaggtgtgccaccacaaaagaatgtaccctgggcagatcaaagaacatattctgtatgtcaggcttggccacaaaagaatgacacaagtaatatgctgtagatcagaacctctctgctaatattgcctttttagcatggttaagatagctaagatctagtactgtcactccagtatgtcccaattctacctacgtttattgaagggtcaacagttctgatctcagcattgggtaaagggtgggacattcagatttacggtccttgataaaaacaatttacaacgttccgttgtgtaataaatgtaagtgtacatatgcctgggacatcagctggaaaagggacagactatcagagagttgcactgttgcggtatgggccaaatccaacataatacccgctgtacctctagagaactaaaaccttaatttctcagatcttttctgcactaatggtctttacatacagcctacattttaactaactcttgcatgggcttgtttcacagcaggaaactatattcatcatatccttattatgatagagaatgacaacattcaaaagggtgtggtgcttctgaaaatatacacaataaatggcatgatttgacctctgtcaaattcttctttcctgctttcctcatatgtgggcttgagtgggtgtatttagctcctttaaaggaaactctttcacaggcagggccacactcttactcgttttgatctcatgaggttacatctgccagtggcgttcagggccagttagataaagttcatcttgtttggattggagagactttttttttttttttttttgagacagggtcttgctctgtaacctaggctcaagtgcagtgcagtggtgcagtcatggctcaccgcagccttggtctcctgggctcaagtgatctttctacttcagcctcctcaatagctgggactacaggcacacaccaccacccccaggtaattaaaaaatttttttttgtagagacagggtctcactatgttgcccagtctgggagaccacattctttaacatgaatattttgtaaatagtccaagaagatctagaggaaagctgaattccttcatctgatttttgccactgggctgcctcccattgtctggctaagtcttcatgggaggcctttaagaaaagctgtgacaaatacctttgtttcccactgcctaggttacataagtagttggcttttccagcctagactcttatattgttgcttgtaagagggcccttctttgcagatttcttttttttttcatctatgctttcaaataggcagatgctagcctgagatcatctctttattgaggtagtttgcccaaaaacagcaaggaacagccaatacctgccaactttctaggtttttccaaccaattctcttacagaaaatctataaatatcttagaggtatgtttcttagtttcccaacatataatgggaaaattcatcatttatattattacttttaactgaagtatgttgttatcagagaacttggtctgtgtcatattaatcctttgccatttgagaagcatacagttttaaagtttatatctccaaaaggatattttgtaaaaatttaacccctttgactcttagtcttctcatttgtgaaaggtaaataataaagaatttctgttcc

SEQ ID NO: 198151 - DNA, 2553 bp, Homo sapiens
  Payload ID: 19090
  Gene Name: unc-45 myosin chaperone B
  Uniprot ID: Q8IWX7
  ENST ID: ENST00000591048
  CDS Start-End: 1-2553
atggcagaggtggaagcggtacagctgaaggaggaaggaaaccggcatttccagctccaggactacaaggccgccacaaatagctacagccaggccctgaagctgaccaaggacaaggccctgctggccacgctttatcggaaccgggcagcctgtggcctgaaaacggagagctacgtccaggcagcttcagatgcctccagagccatcgacatcaactcctcggacatcaaggctctgtatcggcgatgccaggcactggagcacctggggaagctggaccaggccttcaaagacgtgcagcgttgtgccaccctcgagccacggaaccagaacttccaggagatgctgaggagactcaacaccagcattcaggagaagctccgagtgcagttctccacagactcgagggtacagaagatgtttgagatcctcttggatgaaaacagtgaggctgataagcgggaaaaggctgccaacaatctcattgtcctaggccgtgaggaagcaggggctgagaagatcttccagaacaatggagtagccttgctactgcagcttctggacactaagaagcctgagctggtgctggctgcagtgcggaccctgtcgggcatgtgcagcggccaccaagccagagccacagtgattctgcatgcagtgcggatagaccgaatctgtagcctcatggccgtggagaatgaggagatgtctctggctgtctgcaacctgctccaagccatcattgactccttgtctggggaggacaagcgggagcatcgagggaaggaggaggccctggttctagacaccaagaaggacctgaagcagatcaccagccacctgctggacatgctagtcagcaagaaggtgtctggccagggcagggatcaggcgctgaacctgctcaataagaatgttcccaggaaggaccttgccattcatgacaactcacgtaccatctatgtggtggataatggtctgaggaagatcctgaaggttgtggggcaggttccagatctgccatcctgcctgcccctgactgacaacacccgcatgctggcctctatcctcatcaacaagctctatgatgacctgcgctgtgacccggagcgcgatcacttccgcaagatctgtgaggaatatatcacgggcaagtttgacccccaggacatggacaagaacttgaatgccatccagacagtgtcagggatcctgcagggcccctttgacctgggcaaccagctgctgggactgaaaggtgtgatggagatgatggtggcactatgtggctcagagcgcgagacggaccagctggtggccgtggaggccctcatccatgcctccacgaagctcagccgcgccaccttcatcatcaccaatggagtgtcactgctcaaacagatctacaagaccaccaaaaatgagaagatcaagatccgcacactggtgaccagtgacaagaccatcctgtactcggtggccaccaccctggtgaactgcaccaacagctacgatgtcaaggaggtcatcccagagcttgtccagctcgccaagttctccaagcagcatgtgcccgaggaacaccccaaggacaagaaggactttatagacatgcgggtgaagcggcttctgaaggcgggtgtcatctctgccctggcttgcatggtgaaagcagatagtgccatcctcactgaccagaccaaggagctgctggccagggtattcctggcactgtgtgacaacccaaaggaccgaggcaccattgtggctcaaggtggtggcaaggccctgattcccctggctttggagggcacagatgtgggcaaggtgaaggcagcccacgctctagcaaagatcgctgctgtctccaatccggacattgcttttcctggggagcgggtgtatgaggtggtgcggccccttgtaagactcttggacacacagagggatgggcttcagaactatgaggctctcctaggcctcaccaacctgtctgggcggagtgacaaactccggcagaagatctttaaggagagggccttgccagacatcgagaactacatgtttgagaatcatgatcagctgcggcaggcggccaccgagtgcatgtgcaacatggtgctccacaaggaggtacaggaaaggttcttggctgacgggaatgaccggctgaagctggtggtgctgctctgcggggaggatgatgataaggtgcagaatgcggctgcaggggctctggccatgctgacagcagcacacaagaaactgtgcctcaagatgactcaagtgacaacccagtggttggagatcctccagcggctttgcctgcacgaccagctgtctgtccaacaccggggcctggtcattgcctacaacctactggcagccgatgctgagctggccaagaagctggtggagagtgagctgctggagatcctgactgtggtgggcaaacaggagccagatgagaagaaggcagaagtggttcagacagcccgagaatgtctcatcaagtgcatggattatggtttcattaaaccagtgtcttag

SEQ ID NO: 198152 - DNA, 3136 bp, Homo sapiens
  Payload ID: 19091
  Gene Name: unc-5 family C-terminal like
  Uniprot ID: Q8IV45
  ENST ID: ENST00000244565
  CDS Start-End: 118-1674
cttgtttctcggagaaggaactggaccagccagcagcctctaagagctcctagacggcctttggctttggctggcacaggggtgaaggagagccagcggcattgagtaaccaggcgaatgtgcccccaggagagttcattccaaccctcccagttcctactgctggtgggggtcccagtggcaagtgtcctccttctggcccaatgccttcgatggcactgccctagaaggctgctgggggcctgctggacactgaatggtcaagaggaaccagtgtcccagcctaccccccaactagaaaatgaggtctcaaggcagcacctgccagccacactgccagagatggttgccttctaccaggagctacacacacccactcaaggccagaccatggtccgccagttgatgcacaaactgttggtgttttcggctcgagaggtggatcaccgcggcggttgcctgatgctccaggatacaggcatctccttgctcatcccaccaggtgctgtggctgtgggccgccaggagcgggtgtctttgatcctggtgtgggacctgtcggacgccccatcgctgtcccaagcccaggggctggtaagccctgtggtggcatgtggcccccatggggcctccttcctgaagccttgcactctcacgttcaaacactgtgccgagcagcccagccatgctcgcacctacagcagcaacactaccctgctggatgccaaggtatggaggcccctggggcggccgggggcccacgcctcccgggatgagtgtcgcatccacctctcccacttcagcctctacacctgtgtgctggaggcacctgtggggcgcgaagcccgcaaatggctgcagctggccgtattctgctcaccgctggtgccaggacagtcccatctgcaactgcgtatctacttcctcaacaacacgccctgcgccctgcagtgggcactgaccaacgagcagccccatggtgggcgcctgcgtgggccctgccagctcttcgacttcaatggggctaggggcgaccagtgcctgaagctcacgtacatctcagagggttgggagaatgtggatgacagcagttgccagctggttccccatctccacatctggcatggaaagtgccccttccgctccttctgcttccggagaaaagcagccgatgagaatgaggactgttcagcactaaccaatgagatcattgtcaccatgcacaccttccaggatggcttggagaccaagtatatggaaatcctcagattccaggcatcagaggaggaatcctgggcagcgccaccacctgtttcccagccgcccccatgcaataggctgcccccagagctctttgagcagctgcggatgttattggagccaaacagcatcaccggcaatgactggcgcagactggcctcccacctggggctttgcggcatgaagatccggttcctgtcctgccagcgcagccccgcagcggccatcctggagttgtttgaggagcagaacggcagcctgcaggagctgcactacctcatgaccgtcatggagcggctagactgcgcctccgccatccagaactacctgagtgggacacacggcggcagcccaggccccgagcgcgggggcgcccgggataaccagggcctggagctggacgagaagctctgagcgcccagcgggcagggccggaggaggtgtaggggcgagaggggttgttctcctacgcctaagaggaacacagcagctgttcctggctgtgcccaccacccttcccagaaccctcggacggtgccagggccgcccgcgtcctcgccagcctcccagcagcaggcgcgcccttccggccgcgagctgtcccgcgtgcgggtcccctcctggccggcagagggcgcaggagcccaggagatggcctcagcgtggccagcctgccaaactgaccaggggacggccacggtccccgcgtgcactttagggccggtcaggccctaaagtattcactgagcacttaggaagaccgggcattgggctggtgtcatgaagaatactggaatataggaggtagggtctggagccctgacaagcacacagttcttttgcaggagtcaagatgtgctcataggagccaagggcaaactcgaaaacagccctgccctgtggttaggggaggtgggtgtggctttaggagttgagaggggaagagctgagtgcgggctggagcagcgagaatgcttcacggaggatgttggggagagaggatttgatttgccgagtggtttggagatctttaggggcgggtaggggaagagggtggctggacttaaggtaggagccgaaagtgggcatgggagcccatccccgtgggtgtgaggccggggtaggaccaggcttcccggctaggcacgcctggctggctgcctctgcctctactaacttcctttgtctctttatcctcctgcttaggccgtgtcttcctctctctctgccattttctctatcagaaaacattaaagctgagtagaaacttcaagatgatcattctggcccagcccttttatctctttatctccaatggtgtgcgttttaagtttctctgacttggtttttctgtccctgtctcccacagttgttcccgctctgcacctgtgtttcagttactctctctctctgtcttagatctttttgtttctgcctagtctctgtgccctgtctttgtgtgtttctttctctgcctgaaaccctccctcttttcccttcaggcatatgtctctaaaccaatgttatgtatcaaagactgttgaaagagacagggctactctaggaatggatgggtggggatattttccccatggatcaagatccagtttagggttgggaaataaaggatagggataaaagaggcaccccattcagtcagcagatacttattcagcacctactatgtgtttgatactgtatacaaaagacatgaatgggctgggtcctgaacagagaataaagggtttgactccattctggaaattcttttgtttgcaaacaggtgttgttaatttgttcaaaggcaggcaaacaatctctctggcaacacaattttcttctgtatttaattaaaaaatattaaagctttttttct

SEQ ID NO: 198153 - DNA, 1620 bp, Homo sapiens
  Payload ID: 19091
  Gene Name: unc-5 family C-terminal like
  Uniprot ID: Q8IV45
  ENST ID: ENST00000373164
  CDS Start-End: 62-1618
gcctttggctttggctggcacaggggtgaaggagagccagcggcattgagtaaccaggcgaatgtgcccccaggagagttcattccaaccctcccagttcctactgctggtgggggtcccagtggcaagtgtcctccttctggcccaatgccttcgatggcactgccctagaaggctgctgggggcctgctggacactgaatggtcaagaggaaccagtgtcccagcctaccccccaactagaaaatgaggtctcaaggcagcacctgccagccacactgccagagatggttgccttctaccaggagctacacacacccactcaaggccagaccatggtccgccagttgatgcacaaactgttggtgttttcggctcgagaggtggatcaccgcggcggttgcctgatgctccaggatacaggcatctccttgctcatcccaccaggtgctgtggctgtgggccgccaggagcgggtgtctttgatcctggtgtgggacctgtcggacgccccatcgctgtcccaagcccaggggctggtaagccctgtggtggcatgtggcccccatggggcctccttcctgaagccttgcactctcacgttcaaacactgtgccgagcagcccagccatgctcgcacctacagcagcaacactaccctgctggatgccaaggtatggaggcccctggggcggccgggggcccacgcctcccgggatgagtgtcgcatccacctctcccacttcagcctctacacctgtgtgctggaggcacctgtggggcgcgaagcccgcaaatggctgcagctggccgtattctgctcaccgctggtgccaggacagtcccatctgcaactgcgtatctacttcctcaacaacacgccctgcgccctgcagtgggcactgaccaacgagcagccccatggtgggcgcctgcgtgggccctgccagctcttcgacttcaatggggctaggggcgaccagtgcctgaagctcacgtacatctcagagggttgggagaatgtggatgacagcagttgccagctggttccccatctccacatctggcatggaaagtgccccttccgctccttctgcttccggagaaaagcagccgatgagaatgaggactgttcagcactaaccaatgagatcattgtcaccatgcacaccttccaggatggcttggagaccaagtatatggaaatcctcagattccaggcatcagaggaggaatcctgggcagcgccaccacctgtttcccagccgcccccatgcaataggctgcccccagagctctttgagcagctgcggatgttattggagccaaacagcatcaccggcaatgactggcgcagactggcctcccacctggggctttgcggcatgaagatccggttcctgtcctgccagcgcagccccgcagcggccatcctggagttgtttgaggagcagaacggcagcctgcaggagctgcactacctcatgaccgtcatggagcggctagactgcgcctccgccatccagaactacctgagtgggacacacggcggcagcccaggccccgagcgcgggggcgcccgggataaccagggcctggagctggacgagaagctctgagc

SEQ ID NO: 198154 - DNA, 3812 bp, Homo sapiens
  Payload ID: 19092
  Gene Name: unc-5 netrin receptor A
  Uniprot ID: Q6ZN44
  ENST ID: ENST00000329542
  CDS Start-End: 275-2803
accggcccgctctccggctgcgggctccgcggcgcggctggctcggtgcgcggcgcggctggcgctgcgctccgccccggctgcattgctgcgctcccgtgcccaagggagccacgcgccgcgtgcgcccggcagccggccgcccggaggcagcgcagtccgctggcatgggccccgggggcgccccgagctggggctccgggctgaggcgctaaagccgccctcccgcccgcggggccccgcgcccggcccgcccgcctgcccgcccgcggccatggccgtccggcccggcctgtggccagcgctcctgggcatagtcctcgccgcttggctccgcggctcgggtgcccagcagagtgccaccgtggccaacccagtgcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactgcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggtggcggccgccacacactgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggaatcagcctcctcatccccccagatgccataccccgagggaagatctatgagatctacctcacgctgcacaagccggaagacgtgaggttgcccctagctggctgtcagaccctgctgagtcccatcgttagctgtggaccccctggcgtcctgctcacccggccagtcatcctggctatggaccactgtggggagcccagccctgacagctggagcctgcgcctcaaaaagcagtcgtgcgagggcagctgggaggatgtgctgcacctgggcgaggaggcgccctcccacctctactactgccagctggaggccagtgcctgctacgtcttcaccgagcagctgggccgctttgccctggtgggagaggccctcagcgtggctgccgccaagcgcctcaagctgcttctgtttgcgccggtggcctgcacctccctcgagtacaacatccgggtctactgcctgcatgacacccacgatgcactcaaggaggtggtgcagctggagaagcagctggggggacagctgatccaggagccacgggtcctgcacttcaaggacagttaccacaacctgcgcctatccatccacgatgtgcccagctccctgtggaagagtaagctccttgtcagctaccaggagatccccttttatcacatctggaatggcacgcagcggtacttgcactgcaccttcaccctggagcgtgtcagccccagcactagtgacctggcctgcaagctgtgggtgtggcaggtggagggcgacgggcagagcttcagcatcaacttcaacatcaccaaggacacaaggtttgctgagctgctggctctggagagtgaagcgggggtcccagccctggtgggccccagtgccttcaagatccccttcctcattcggcagaagataatttccagcctggacccaccctgtaggcggggtgccgactggcggactctggcccagaaactccacctggacagccatctcagcttctttgcctccaagcccagccccacagccatgatcctcaacctgtgggaggcgcggcacttccccaacggcaacctcagccagctggctgcagcagtggctggactgggccagccagacgctggcctcttcacagtgtcggaggctgagtgctgaggccggccaggcccgacacctacactctcaccagctttggcacccaccaaggacaggcagaagccggacaggggcccttccccacaccggggagagctgctcggacaggccccctcccggccgaagctgtcccttaatgctggtccttcagaccctgcccgaactcccacctctccatggcctgcctagccaggctggcactgccactcacactcggccccagggcccaggagggacagtgcctggagcctgggccaggcccagcccatctgtgtgtgtgtatgtgcgtgtgatgctacctctcctcccgtccctctccaggggccccgcatacacacggccatgcacgcacacactgggcctgggccagggccccagagctcctgcctgagctggaccttatgcaaacatttctgtgcctgctgggtaggggcacgtctgaggggccctgctccaagcctgcaggaccgagggccacagccggacagggggtagcccctggattcaggcacacgaccaccacacgagcacgtgccacgcatgcctcgtgtgctcatctcacacacacccccctcccgggtcacgcagacaccccccaaccacacacatctcatgctgtacacctgaggctgctcacgtctcacgcccagtgttggtgcacatttgcctctcacatgctgccctctccacccacccagggacaccccacggctcctccctgcccctgcccctcccccagccttgaggtgccctgcccggcggggcctgtgaatatgcaatgggagtcccaggctgtacagtggtgagtgtgtgtgtggcgtggcgtgcccgtccccagggctggctggtgccccacgcggggcctgtcatgtgaagctcgtgtcctgactttgtcttaagtgcattcacgcacttactcttggccttatgtacacagccttgcccggccgccggggcacataggggttttatcgggcgtgaatgtaaataaattatatatatatattgc

SEQ ID NO: 198155 - DNA, 1031 bp, Homo sapiens
  Payload ID: 19092
  Gene Name: unc-5 netrin receptor A
  ENST ID: ENST00000509580
  CDS Start-End: 1-1031
gcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtgaacggtgggtggtcgacgtggaccgagtggtccgtctgcagcgccagctgtgggcgcggctggcagaaacggagccggagctgcaccaacccggcgcctctcaacgggggcgctttctgtgaggggcagaatgtccagaaaacagcctgcgccaccctgtgcccagtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactgcttctggccctgaggacgtggccctctatgtgggcctcatcgccgtggccgtctgcctggtcctgctgctgcttgtcc

SEQ ID NO: 198156 - DNA, 1518 bp, Homo sapiens
  Payload ID: 19092
  Gene Name: unc-5 netrin receptor A
  ENST ID: ENST00000513890
  CDS Start-End: 1-254
gtgcccagcagagtgccaccgtggccaacccagtgcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgagggagatagagagggttggcggccaatgtagcccaacagaaccctgggcaccaacacctcccaggaccagagcctctcccggccccagcggaggtgccagaggcctccctgcccagcagcagggcccaccttgtcttgctgggagggtctgcaggagaaccgcagggtcctcttctgccccgagcatccgactccagcctcccatggccggaacatctgaacgttcattgatctcatcgatttctcaacccaaagccatcgagtgctttgaggtgaagaaaaaggctttccttacccacggcagataccacggcagtggcgccacgccgccaaagaccaaagaccccaaaccagaaacgttctgtggtcagacagggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactgcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggt

SEQ ID NO: 198157 - DNA, 6841 bp, Homo sapiens
  Payload ID: 19093
  Gene Name: unc-5 netrin receptor B
  Uniprot ID: Q8IZJ1
  ENST ID: ENST00000335350
  CDS Start-End: 417-3254
attgtggcaggcggctggggccggctagggcgccggagccgcacgcagccgcggggctccgagaggcgcgcactggggctgggactgcgcggcgccgccgctgcgagcgccactgagcggtcgcgcaacttcggaggcacagcgccggagccaggcgagcgctcagagacccggagccagaggggcgcgccggagcctcgttcgagagccggcgccaggcacccaccgcgctccgagtgccaggcggccctccgcgcagcgtggcttccgctgcccccacggaaggcacgggctggcgctgccgggcgccggggaggacggcgaggaggaggcggcggcggcggagacggcggcggcgagactggggccagggagacagccctgggggagaggcgcccgaaccaggccgcgggagcatgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttctcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaagaaaatgaaaaacaacacaaaaaaaatagaaaactcttttcttgagtgtggatgagaatgggcacgctcacacttctggccaggagtgaatgtgcctgtgtgtgtgtgtgtgtgtgtgtgtgtgtgtgtacatgtacgcgtgtgcattgaggagagagagactgaacagagagtactttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 198158 - DNA, 6451 bp, Homo sapiens
  Payload ID: 19093
  Gene Name: unc-5 netrin receptor B
  Uniprot ID: Q8IZJ1
  ENST ID: ENST00000373192
  CDS Start-End: 60-2864
gagactggggccagggagacagccctgggggagaggcgcccgaaccaggccgcgggagcatgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaatgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttctcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaagaaaatgaaaaacaacacaaaaaaaatagaaaactcttttcttgagtgtggatgagaatgggcacgctcacacttctggccaggagtgaatgtgcctgtgtgtgtgtgtgtgtgtgtgtgtgtgtgtgtacatgtacgcgtgtgcattgaggagagagagactgaacagagagtactttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 198159 - DNA, 9875 bp, Homo sapiens
  Payload ID: 19094
  Gene Name: unc-5 netrin receptor C
  Uniprot ID: O95185
  ENST ID: ENST00000453304
  CDS Start-End: 350-3145
cagacttcggcgtgcggcggagctgcggctgctcctgctgctggggggagcggcggaggtggccgccttgcgcctccctggacttcccaagtgggggcagagcagtcgctcgcgggagacgtcagttagaaggcattgggaaagagggaccttcaaactcctcctcggcgtctcctctcctcccccttttggcccctgcctttggagaaagtggagtgtggcgcttggttgtcgttatttcttcggactgcttcgcggtgcacggattcagcttctgcccagtggggctttcagctgtttgcgcgtctctctgtccccctcccctccccccggcacacctctgtctacgatgaggaaaggtctgcgggcgacagcggcccgctgcggactgggactgggatacttgctgcaaatgctcgtgctacctgccctggccctgctcagcgccagcggcactggctccgccgcccaagatgatgacttttttcatgaactcccagaaacttttccttctgatccacctgagcctctgccacatttccttattgagcctgaagaagcttatattgtgaagaataagcccgtgaacctgtactgtaaagcaagccctgccacccagatctatttcaagtgtaatagtgaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacattgttgccaagaggaaaagtacaactgccactgtcatagtctatgtcaacggtggctggtccacctggacggagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagactgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcgctgggaggtcaccttattgttcccaattcaggagtcagcttgctgattcccgctggggccattccccaagggagagtctacgaaatgtatgtgactgtacacaggaaagaaactatgaggccacccatggatgactctcagacacttttgacccctgtggtgagctgtgggcccccaggagctctgctcacccgcccagtcgtcctcactatgcatcactgcgcagaccccaataccgaggactggaaaatactgctcaagaaccaggcagcacagggacagtgggaggatgtggtggtggtcggggaggaaaacttcaccaccccctgctacattcagctggatgcagaggcctgccacatcctcacagagaacctcagcacctacgccctggtaggacattccaccaccaaagcggctgcgaagcgcctcaagctggccatctttgggcccctgtgctgctcctcgctggagtacagcatccgagtctactgtctggatgacacccaggatgccctgaaggaaattttacatcttgagagacagatgggaggacagctcctagaagaacctaaggctcttcattttaaaggcagcacccacaacctgcgcctgtcaattcacgatatcgcccattccctctggaagagcaaattgctggctaaatatcaggaaattccattttaccatgtttggagtggatctcaaagaaacctgcactgcaccttcactctggaaagatttagcctgaacacagtggagctggtttgcaaactctgtgtgcggcaggtggaaggagaagggcagatcttccagctcaactgcaccgtgtcagaggaacctactggcatcgatttgccgctgctggatcctgcgaacaccatcaccacggtcacggggcccagtgctttcagcatccctctccctatccggcagaagctctgtagcagcctggatgccccccagacgagaggccatgactggaggatgctggcccataagctgaacctggacaggtacttgaattactttgccaccaaatccagcccaactggcgtaatcctggatctttgggaagcacagaacttcccagatggaaacctgagcatgctggcagctgtcttggaagaaatgggaagacatgaaacggtggtgtccttagcagcagaagggcagtattaaccaccatgctggaaggggaaatgaaggacaaaaatgcacagggagtctgtggccgtccaggtgaatcacagctgaggaggaaatccagatgagaccaatgcacttcacaggcaagactgcagcaggagccagaaggaaaacagatacaactgcccatgtacatgcccactttactcggacatcatcacgggagttaagaaaaattgtgtaaatttgtaccttgaatttagctatcaacctaattttcctcttagttgggctgtatgctgtgtggtacaggatcttacagtttcctaggaaacgctttttattgctatccagatatatggataaactttcttaacaaacccaatttctacaaatgttgtttacatcaaattggacagggatgcagacactgtccatggctcgttctatttttgttcaaatcatttgaagttgaagctgtggacggtttgttgtgtctatttcagattagtaatttacagagaaatcacagacttttgctacaaatcgtgtgcatcaagtgtctcagataatcctcccatcagtgttctgtttctagaacttgtagaaccagtgttactgtttgtatcagggaagtggagaatctaagtgtaaaaaagaaataactaagactcctattccttggagggacccttctggtgccctttgggaataaagctgtagcactgcagggaagacagtgattcatgttcaaccccacaaacaagcatttttttcacaacatgtgtgtttgtttgtaatatgcaatatgaagtgtttttttttaaaggtattattattatttacaggtattctggtaaaatgatttttttaaatttctatttttgttagcagtgctgtttgttagtatttggttattgactagacctgtcccaccttttcacctatcaaggtgggtgtggtcatcagtttaattcaacatgcatcacttccttgaccttttacctttcccttattccaccccagaaaggtgattgataaatgctgaatggctttgtcagtctgttccttcagcttgctcaggcagggtctttctttctcctctgaggagtcttaaggagacgtgttctctattaagttcacttaatattgccgttgtgtggccccacgtcgactccctatggtgctctactctagaggcagtgtggttggaggaatggactctaaactggagatcaagaaaccagttctcattgtgggtctgtcactgtcttgttgcgccaccttgagaaagtcatttaaccacacgacctcagtgtcctcactagaaagtgaaagggtgggattagatcatctccaagttctgaaatgctcaacttccaccgtgatgcctccagtctcattcatcagtctgaagaccacaatggactctgacctggatcatcatttaaaaatcatcagctggtcttttgcccaggctatgttacgcctttcaagtagttctgacaaggaagatgattattctaaccagcattatgatgttgtttgtttggcctgagtcgctctgcatcattgcattatgctgttcactgagagatgacatccctttattatcattttcttagcctctcttgggatgcccctgcccccagccttcctgactggttgcaaattctgttttttattattgtcttggcatcttgatatctagaccactcctacaagtttatctggcagtaggaacttggtgcatttttttctacgctacacccccccacccttaatctttctttgctgtcataatattcagtagcatttataaaagctgtctagttagctctttaaaaacttttgtcctgcaaaatgtttgttagtcaacacactactttgtgtaaacaactattatgtttccttgggaccatcacaagctctttaacaaacacaaggactcaattcattcagcaggtggggattaaagaatcaaagcccagtagcaaaaccaaaactgaagaacaagcagacatgtgtatgaatcggaacctttagaacatgactgtggtttacttttaggctggaggcacacaagttgctgaacagacttgaattatacatgtgcttccatctttccatgtttccgctcctattttggtagcatcttgagattccttgatgcctccgccatcctcatccctgaggaactgctgataccttgctatggaacctcttctttctttcatgctttttattccgtatcttctgttttggacatacatacatatattctataaaatctctctcagcccaccccctgcattaggatttccatatttaaaatatttgtacactgactggggaagggagagattgcactataaacaagttcagtggatgtttgtagcaatgagtaaaactgtattctaaattaaaaatcaaatatatatacacgcagttatacacacacattttttaaaaggaggaggaggaaagagagctattgtccattcctacattttgaaataaacttgtcaagattacgcatcagtaccagggttgtggaatcatctatggaaatcaagaactagaatctgaactgaatggtcaaagaaacttctatgcctagtgaaaactagaggggagcaactatgtagctatgaacatgaatcaattccataactgttactaaaaacttattttgactaaaaagtcaccaacacagaactattgaacacaaacaggaattgtttgtcttactgaagtcactgagaacccttggggttcacttcagatgcttttttggttcaacttcccaccaccagaaaagggaaaagtgattgatttcgtgtgtgaggtactcatctgtcagaacccttaatgtttcctattaagtgaatgacaacttccatacatacactatttataccaaataattttcactacaaattctgatttccttctcctttggagtaaagtaatagctgttagattgctttcaaacttagaaggtccagatataacagttcatttcataggaagccacttcatcaaccattctatgtgatacatcctgcttctttctacaccgctggagaggcagtttggctggtttcatttggatagaaaaaactatcatttgtgcatgctgccatctagtggtgtacaacacaatctaacctgagtttaatattcactagaatgtgtttgacgaagggaatgaaaacctgtagagttcaaggacctttatgacaaacagatgtagggaaattttcacttcaaatttataattttcttattctcacttttttttcatttgcatcactcatctcaatattaggtcactgtgagcccagtacatcaactcattcatacacaacatatcttcagttgcttcttgtaacagaactatgtaaaatctatataaaacagtctttgaagagttgtcatttttaacacttatggttttcattggggtttgtatactttaaatctccttttagttccttaatatttatctttggaaatgtaagaagtatctgcttagaaagaaataagtcttatatatgcgaatggaatactatgtctagggaagagaaaattggggttgttaatcaaagggaagaaagcagcttcttttctgctgaatttgggaatccaaaggcagaggtttcatcctgtttttattttcttcttatcacactctttcaagtttccttaatgtatctggaaggaatagaagttggattcagaattgataactggcatggtgatgacaaacctgtgtaacaccaaggttctcacagctaacagctgtttcacaaacggcatcttccaaatgaacagtcacctctgctatgcagaaaacccccatcctgctgtgagcaagttaggctcttcaagaactggacaacttttgggtgaggtgttcaatatcaaactgcataatcattagccattttcatatatactattttatagatttaagtctctcaactatcaaaaagtagagcgattttcaggagaaaaaagtcgtggggactgagttcaggacaccctgaaactatgcgaccagtaatttttttaaggtattttttcctacaagtaaggtatctgaaaagtcaacgttttgagggtggaatcaagacttttcacttctcctggcaaagagcaacaaggctcttgtctcgtgtccttctgtgtgtctctgtcaggatcacagcagctgtgctcttggtctgcttactcctctgtaatccacgtatgcagaagggagttaataaggtgatcaccatctccccagaattcaaaggtctttgcctctataaggtctgcccctatggggccaggaaaatataaacctatataaggacttgcaagagagcataaagaaggtagaaaaggtttacttgttgggttttcaagccttcaagttgaatgagtcttagcttttgctgggcagttgttctggacaagtcatcagtttcatgtggagaactcagtgtaagcccaaggctaatgaatgagaggggtcccatggaaacacagctgaaatgaaatgggactttatccatcttctttgagaatggaagagcttttgtgaagcagtacatcattgctcaagataatggttgataagcattagattttatagatctaataaggaaaatattttattatctcaagttaacaaaacatttttttacctctcgagtgcctcataggaccaactattactctttggcttttatttttctttttgtattatttttatatattctttaaccttgctgagctagtattgactgaaatctttagaactttgcctctgggcaatgaagtaatgtttctctaccctaagatatctatttgtataatctctggctgtaatgatcactttggaagatttcctttgcatctctaattatttctttttaatggaataaggcataagggggaataaatatattgtaaccaatgttatgtaaacccatatccatacaggccaggaaagccaaatgaagtcatttccagaattctagtgtgaaaaacctatttttgaaaagtggggagatggctttgtgtagaactgggtgggttttctctgcagactaagtctagccatgagcttccagatcctttagttttatcagccttgtgcttaccccattttcataaatgctactttaacagccagtcttcataagtcatggttcctaggttttcctgtcacctcattgtattcatctgtggtaggatattaacgggctcattcaaccaaatgtaatgtgtgcctcagacctatttagcatggttggggggcatcagcaggacaaaccaacaggtactccgcaagtgtactggcacagcaagcccaccaattattagcagctcttcatcagcctgctgtctactcagacgcttgcctactgaagggacctgtccagagatcttctggaatcccaggttgggaatctctgcagaatgtcgtgacagttgtggcccaactagcttctgagtagaaacaaggaagctaccctgagatatagtcagctgcccacctgccatagtatttgctactgaatgccagccttttaacataccatttcagatttgtccttcaacaaaaatataaattgcaagtcataccatttaagggtcttttacaaatatgtctaaattgtgtgtcatttttaagttccaaaggtctactggactaagtactatcagaccagctgtagaacctgatggcgctgatccggggtggaataaccctcagtactggtgtgtagaagatgaattgtaggcaggttttgctgatcagcagcctaaggattgatgggctctcttttggcctctgatcctgagcactatggaggcagcatcagagaatggggacctgagctacataggttctcaatgttaaaacaactctgttcggagtgacatataagagcaagaaatctacagctggtgtaaaatacctttgccttttctatcccgaaagtaacaaatggcatctgtacatgtaggggtaaaaactcagatgtctactcctccaggccatggacaagaaaaagtacagcagtcagaacagtggaacaagtgatttgcattctcttcttcacgctttcctagatctgccattggtagcgcagccctcgccctccagacataatgcatcgagcccagttgcagggaacatcactgtgtgtgtgtgatgtcatggtgttatatgtgttgagtttaatgttgagctgaagcaagttggtgaccttcctctttgctctttgtaaagaagacaccaatgtttgtcagagaaaaatccccagcagtcgtgttgaagaggcagtgtcatccacctactgtcccctttggaacagttcaactgcagaaaggtcggattgaggttttgtgctttgtcgtttttcttttttaaacaaaacatgacaaccttggcttttccgatatggaacacttttgttgttgtggagttccctcttgctgtatcttctatgcaattccttttctaaaaaaaccccccggcagaggcagagtgccctccggatatctgtccggcgccttgctgagtggtggaggtgagggataccagctccgggtgtgcctcttttctctccctggctgccaatcctgattttccctgcagtccccttggtttgtaaattgcctgcatttattctgtcagccaacatgtacaaaatgtaagaaagaatttttaaacaggtaataaattatatttataagcaacaaa

SEQ ID NO: 198160 - DNA, 1789 bp, Homo sapiens
  Payload ID: 19094
  Gene Name: unc-5 netrin receptor C
  ENST ID: ENST00000504962
  CDS Start-End: 344-1126
tcggcgtgcggcggagctgcggctgctcctgctgctggggggagcggcggaggtggccgccttgcgcctccctggacttcccaagtgggggcagagcagtcgctcgcgggagacgtcagttagaaggcattgggaaagagggaccttcaaactcctcctcggcgtctcctctcctcccccttttggcccctgcctttggagaaagtggagtgtggcgcttggttgtcgttatttcttcggactgcttcgcggtgcacggattcagcttctgcccagtggggctttcagctgtttgcgcgtctctctgtccccctcccctccccccggcacacctctgtctacgatgaggaaaggtctgcgggcgacagcggcccgctgcggactgggactgggatacttgctgcaaatgctcgtgctacctgccctggccctgctcagcgccagcggcactggctccgccgcccaagatgatgacttttttcatgaactcccagaaacttttccttctgatccacctgagcctctgccacatttccttattgagcctgaagaagcttatattgtgaagaataagcccgtgaacctgtactgtaaagcaagccctgccacccagatctatttcaagtgtaatagtgaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacattgttgccaagaggaaaagtacaactgccactgtcatagtctatggtccttgagaaacagcgggctcaagatcactctgctagtcctgtctcttaaaagcaggagaggagattttcagctgaaagatggcttccctataccagaaggaaagtaacattcttatcctcaaggacaggaagttgagaccacggggaagttacgatccagataattctgtatcgatcttattaaaataactcttaatcttcttttagccttaacacataattgactttttcataacttgctactctttgtccaattcaatatataagcattcaactataactgcatctttgggtcttcattttcttaggccatgtaaaagttatattaagtaaatttacatgtttttctcctgttgatttgtgttacaccaatttaattcttaggcccagccaaaaaaaaaatcctaaaagagtggaagtaaaatattgcctaccccacagtaccattcagatggatgtgtgtttatgagaagagaaaccactatgctgttccaaaggatgaatgtagtgctgctttaaaaatgtcattttaattacaggaaaaatggcacaaaaattttttgatcctctgattaccctgaggtttaatttcctagtccagataatggctgtgttgaattgtatgcaattgcctttcttaaatcacaataaaatgttttcttcttctta

SEQ ID NO: 198161 - DNA, 2220 bp, Homo sapiens
  Payload ID: 19094
  Gene Name: unc-5 netrin receptor C
  Uniprot ID: O95185
  ENST ID: ENST00000506749
  CDS Start-End: 350-2143
cagacttcggcgtgcggcggagctgcggctgctcctgctgctggggggagcggcggaggtggccgccttgcgcctccctggacttcccaagtgggggcagagcagtcgctcgcgggagacgtcagttagaaggcattgggaaagagggaccttcaaactcctcctcggcgtctcctctcctcccccttttggcccctgcctttggagaaagtggagtgtggcgcttggttgtcgttatttcttcggactgcttcgcggtgcacggattcagcttctgcccagtggggctttcagctgtttgcgcgtctctctgtccccctcccctccccccggcacacctctgtctacgatgaggaaaggtctgcgggcgacagcggcccgctgcggactgggactgggatacttgctgcaaatgctcgtgctacctgccctggccctgctcagcgccagcggcactggctccgccgcccaagatgatgacttttttcatgaactcccagaaacttttccttctgatccacctgagcctctgccacatttccttattgagcctgaagaagcttatattgtgaagaataagcccgtgaacctgtactgtaaagcaagccctgccacccagatctatttcaagtgtaatagtgaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacattgttgccaagaggaaaagtacaactgccactgtcatagtctatgtcaacggtggctggtccacctggacggagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagagtttcatttatcccatttcaactgaacagagaacccagaatgaatatggattttcttctgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcgctgggaggtcaccttattgttcccaattcaggagtcagcttgctgattcccgctggggccattccccaagggagagtctacgaaatgtatgtgactgtacacaggaaagaaactatgaggtaaatatgctttttctggtgcactgactttaccaatgtctaacttggaggagaattgtacaatagacacaataaacccaa

SEQ ID NO: 198162 - DNA, 2350 bp, Homo sapiens
  Payload ID: 19094
  Gene Name: unc-5 netrin receptor C
  ENST ID: ENST00000513796
  CDS Start-End: 116-2350
ttatttcttcggactgcttcgcggtgcacggattcagcttctgcccagtggggctttcagctgtttgcgcgtctctctgtccccctcccctccccccggcacacctctgtctacgatgaggaaaggtctgcgggcgacagcggcccgctgcggactgggactgggatacttgctgcaaatgctcgtgctacctgccctggccctgctcagcgccagcggcactggctccgccgcccaagatgatgacttttttcatgaactcccagaaacttttccttctgatccacctgagcctctgccacatttccttattgagcctgaagaagcttatattgtgaagaataagcccgtgaacctgtactgtaaagcaagccctgccacccagatctatttcaagtgtaatagtgaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacattgttgccaagaggaaaagtacaactgccactgtcatagtctatgtcaacggtggctggtccacctggacggagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagagtttcatttatcccatttcaactgaacagagaacccagaatgaatatggattttcttctgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcgctgggaggtcaccttattgttcccaattcaggagtcagcttgctgattcccgctggggccattccccaagggagagtctacgaaatgtatgtgactgtacacaggaaagaaactatgaggccacccatggatgactctcagacacttttgacccctgtggtgagctgtgggcccccaggagctctgctcacccgcccagtcgtcctcactatgcatcactgcgcagaccccaataccgaggactggaaaatactgctcaagaaccaggcagcacagggacagtgggaggatgtggtggtggtcggggaggaaaacttcaccaccccctgctacattcagctggatgcagaggcctgccacatcctcacagagaacctcagcacctacgccctggtaggacattccaccaccaaagcggctgcgaagcgcctcaagctggccatctttgggcccctgtgctgctcctcgctggagtacagcatccgagtctactgtctggatgacacccaggatgccctgaaggaaattttacatcttgagagacagatgggaggacagctccta

SEQ ID NO: 198163 - DNA, 9403 bp, Homo sapiens
  Payload ID: 19094
  Gene Name: unc-5 netrin receptor C
  ENST ID: ENST00000610318
  CDS Start-End: 1-2673
gatgatgacttttttcatgaactcccagaaacttttccttctgatccacctgagcctctgccacatttccttattgagcctgaagaagcttatattgtgaagaataagcccgtgaacctgtactgtaaagcaagccctgccacccagatctatttcaagtgtaatagtgaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacattgttgccaagaggaaaagtacaactgccactgtcatagtctatgtcaacggtggctggtccacctggacggagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagactgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcgctgggaggtcaccttattgttcccaattcaggagtcagcttgctgattcccgctggggccattccccaagggagagtctacgaaatgtatgtgactgtacacaggaaagaaactatgaggccacccatggatgactctcagacacttttgacccctgtggtgagctgtgggcccccaggagctctgctcacccgcccagtcgtcctcactatgcatcactgcgcagaccccaataccgaggactggaaaatactgctcaagaaccaggcagcacagggacagtgggaggatgtggtggtggtcggggaggaaaacttcaccaccccctgctacattcagctggatgcagaggcctgccacatcctcacagagaacctcagcacctacgccctggtaggacattccaccaccaaagcggctgcgaagcgcctcaagctggccatctttgggcccctgtgctgctcctcgctggagtacagcatccgagtctactgtctggatgacacccaggatgccctgaaggaaattttacatcttgagagacagatgggaggacagctcctagaagaacctaaggctcttcattttaaaggcagcacccacaacctgcgcctgtcaattcacgatatcgcccattccctctggaagagcaaattgctggctaaatatcaggaaattccattttaccatgtttggagtggatctcaaagaaacctgcactgcaccttcactctggaaagatttagcctgaacacagtggagctggtttgcaaactctgtgtgcggcaggtggaaggagaagggcagatcttccagctcaactgcaccgtgtcagaggaacctactggcatcgatttgccgctgctggatcctgcgaacaccatcaccacggtcacggggcccagtgctttcagcatccctctccctatccggcagaagctctgtagcagcctggatgccccccagacgagaggccatgactggaggatgctggcccataagctgaacctggacaggtacttgaattactttgccaccaaatccagcccaactggcgtaatcctggatctttgggaagcacagaacttcccagatggaaacctgagcatgctggcagctgtcttggaagaaatgggaagacatgaaacggtggtgtccttagcagcagaagggcagtattaaccaccatgctggaaggggaaatgaaggacaaaaatgcacagggagtctgtggccgtccaggtgaatcacagctgaggaggaaatccagatgagaccaatgcacttcacaggcaagactgcagcaggagccagaaggaaaacagatacaactgcccatgtacatgcccactttactcggacatcatcacgggagttaagaaaaattgtgtaaatttgtaccttgaatttagctatcaacctaattttcctcttagttgggctgtatgctgtgtggtacaggatcttacagtttcctaggaaacgctttttattgctatccagatatatggataaactttcttaacaaacccaatttctacaaatgttgtttacatcaaattggacagggatgcagacactgtccatggctcgttctatttttgttcaaatcatttgaagttgaagctgtggacggtttgttgtgtctatttcagattagtaatttacagagaaatcacagacttttgctacaaatcgtgtgcatcaagtgtctcagataatcctcccatcagtgttctgtttctagaacttgtagaaccagtgttactgtttgtatcagggaagtggagaatctaagtgtaaaaaagaaataactaagactcctattccttggagggacccttctggtgccctttgggaataaagctgtagcactgcagggaagacagtgattcatgttcaaccccacaaacaagcatttttttcacaacatgtgtgtttgtttgtaatatgcaatatgaagtgtttttttttaaaggtattattattatttacaggtattctggtaaaatgatttttttaaatttctatttttgttagcagtgctgtttgttagtatttggttattgactagacctgtcccaccttttcacctatcaaggtgggtgtggtcatcagtttaattcaacatgcatcacttccttgaccttttacctttcccttattccaccccagaaaggtgattgataaatgctgaatggctttgtcagtctgttccttcagcttgctcaggcagggtctttctttctcctctgaggagtcttaaggagacgtgttctctattaagttcacttaatattgccgttgtgtggccccacgtcgactccctatggtgctctactctagaggcagtgtggttggaggaatggactctaaactggagatcaagaaaccagttctcattgtgggtctgtcactgtcttgttgcgccaccttgagaaagtcatttaaccacacgacctcagtgtcctcactagaaagtgaaagggtgggattagatcatctccaagttctgaaatgctcaacttccaccgtgatgcctccagtctcattcatcagtctgaagaccacaatggactctgacctggatcatcatttaaaaatcatcagctggtcttttgcccaggctatgttacgcctttcaagtagttctgacaaggaagatgattattctaaccagcattatgatgttgtttgtttggcctgagtcgctctgcatcattgcattatgctgttcactgagagatgacatccctttattatcattttcttagcctctcttgggatgcccctgcccccagccttcctgactggttgcaaattctgttttttattattgtcttggcatcttgatatctagaccactcctacaagtttatctggcagtaggaacttggtgcatttttttctacgctacacccccccacccttaatctttctttgctgtcataatattcagtagcatttataaaagctgtctagttagctctttaaaaacttttgtcctgcaaaatgtttgttagtcaacacactactttgtgtaaacaactattatgtttccttgggaccatcacaagctctttaacaaacacaaggactcaattcattcagcaggtggggattaaagaatcaaagcccagtagcaaaaccaaaactgaagaacaagcagacatgtgtatgaatcggaacctttagaacatgactgtggtttacttttaggctggaggcacacaagttgctgaacagacttgaattatacatgtgcttccatctttccatgtttccgctcctattttggtagcatcttgagattccttgatgcctccgccatcctcatccctgaggaactgctgataccttgctatggaacctcttctttctttcatgctttttattccgtatcttctgttttggacatacatacatatattctataaaatctctctcagcccaccccctgcattaggatttccatatttaaaatatttgtacactgactggggaagggagagattgcactataaacaagttcagtggatgtttgtagcaatgagtaaaactgtattctaaattaaaaatcaaatatatatacacgcagttatacacacacattttttaaaaggaggaggaggaaagagagctattgtccattcctacattttgaaataaacttgtcaagattacgcatcagtaccagggttgtggaatcatctatggaaatcaagaactagaatctgaactgaatggtcaaagaaacttctatgcctagtgaaaactagaggggagcaactatgtagctatgaacatgaatcaattccataactgttactaaaaacttattttgactaaaaagtcaccaacacagaactattgaacacaaacaggaattgtttgtcttactgaagtcactgagaacccttggggttcacttcagatgcttttttggttcaacttcccaccaccagaaaagggaaaagtgattgatttcgtgtgtgaggtactcatctgtcagaacccttaatgtttcctattaagtgaatgacaacttccatacatacactatttataccaaataattttcactacaaattctgatttccttctcctttggagtaaagtaatagctgttagattgctttcaaacttagaaggtccagatataacagttcatttcataggaagccacttcatcaaccattctatgtgatacatcctgcttctttctacaccgctggagaggcagtttggctggtttcatttggatagaaaaaactatcatttgtgcatgctgccatctagtggtgtacaacacaatctaacctgagtttaatattcactagaatgtgtttgacgaagggaatgaaaacctgtagagttcaaggacctttatgacaaacagatgtagggaaattttcacttcaaatttataattttcttattctcacttttttttcatttgcatcactcatctcaatattaggtcactgtgagcccagtacatcaactcattcatacacaacatatcttcagttgcttcttgtaacagaactatgtaaaatctatataaaacagtctttgaagagttgtcatttttaacacttatggttttcattggggtttgtatactttaaatctccttttagttccttaatatttatctttggaaatgtaagaagtatctgcttagaaagaaataagtcttatatatgcgaatggaatactatgtctagggaagagaaaattggggttgttaatcaaagggaagaaagcagcttcttttctgctgaatttgggaatccaaaggcagaggtttcatcctgtttttattttcttcttatcacactctttcaagtttccttaatgtatctggaaggaatagaagttggattcagaattgataactggcatggtgatgacaaacctgtgtaacaccaaggttctcacagctaacagctgtttcacaaacggcatcttccaaatgaacagtcacctctgctatgcagaaaacccccatcctgctgtgagcaagttaggctcttcaagaactggacaacttttgggtgaggtgttcaatatcaaactgcataatcattagccattttcatatatactattttatagatttaagtctctcaactatcaaaaagtagagcgattttcaggagaaaaaagtcgtggggactgagttcaggacaccctgaaactatgcgaccagtaatttttttaaggtattttttcctacaagtaaggtatctgaaaagtcaacgttttgagggtggaatcaagacttttcacttctcctggcaaagagcaacaaggctcttgtctcgtgtccttctgtgtgtctctgtcaggatcacagcagctgtgctcttggtctgcttactcctctgtaatccacgtatgcagaagggagttaataaggtgatcaccatctccccagaattcaaaggtctttgcctctataaggtctgcccctatggggccaggaaaatataaacctatataaggacttgcaagagagcataaagaaggtagaaaaggtttacttgttgggttttcaagccttcaagttgaatgagtcttagcttttgctgggcagttgttctggacaagtcatcagtttcatgtggagaactcagtgtaagcccaaggctaatgaatgagaggggtcccatggaaacacagctgaaatgaaatgggactttatccatcttctttgagaatggaagagcttttgtgaagcagtacatcattgctcaagataatggttgataagcattagattttatagatctaataaggaaaatattttattatctcaagttaacaaaacatttttttacctctcgagtgcctcataggaccaactattactctttggcttttatttttctttttgtattatttttatatattctttaaccttgctgagctagtattgactgaaatctttagaactttgcctctgggcaatgaagtaatgtttctctaccctaagatatctatttgtataatctctggctgtaatgatcactttggaagatttcctttgcatctctaattatttctttttaatggaataaggcataagggggaataaatatattgtaaccaatgttatgtaaacccatatccatacaggccaggaaagccaaatgaagtcatttccagaattctagtgtgaaaaacctatttttgaaaagtggggagatggctttgtgtagaactgggtgggttttctctgcagactaagtctagccatgagcttccagatcctttagttttatcagccttgtgcttaccccattttcataaatgctactttaacagccagtcttcataagtcatggttcctaggttttcctgtcacctcattgtattcatctgtggtaggatattaacgggctcattcaaccaaatgtaatgtgtgcctcagacctatttagcatggttggggggcatcagcaggacaaaccaacaggtactccgcaagtgtactggcacagcaagcccaccaattattagcagctcttcatcagcctgctgtctactcagacgcttgcctactgaagggacctgtccagagatcttctggaatcccaggttgggaatctctgcagaatgtcgtgacagttgtggcccaactagcttctgagtagaaacaaggaagctaccctgagatatagtcagctgcccacctgccatagtatttgctactgaatgccagccttttaacataccatttcagatttgtccttcaacaaaaatataaattgcaagtcataccatttaagggtcttttacaaatatgtctaaattgtgtgtcatttttaagttccaaaggtctactggactaagtactatcagaccagctgtagaacctgatggcgctgatccggggtggaataaccctcagtactggtgtgtagaagatgaattgtaggcaggttttgctgatcagcagcctaaggattgatgggctctcttttggcctctgatcctgagcactatggaggcagcatcagagaatggggacctgagctacataggttctcaatgttaaaacaactctgttcggagtgacatataagagcaagaaatctacagctggtgtaaaatacctttgccttttctatcccgaaagtaacaaatggcatctgtacatgtaggggtaaaaactcagatgtctactcctccaggccatggacaagaaaaagtacagcagtcagaacagtggaacaagtgatttgcattctcttcttcacgctttcctagatctgccattggtagcgcagccctcgccctccagacataatgcatcgagcccagttgcagggaacatcactgtgtgtgtgtgatgtcatggtgttatatgtgttgagtttaatgttgagctgaagcaagttggtgaccttcctctttgctctttgtaaagaagacaccaatgtttgtcagagaaaaatccccagcagtcgtgttgaagaggcagtgtcatccacctactgtcccctttggaacagttcaactgcagaaaggtcggattgaggttttgtgctttgtcgtttttcttttttaaacaaaacatgacaaccttggcttttccgatatggaacacttttgttgttgtggagttccctcttgctgtatcttctatgcaattccttttctaaaaaaaccccccggcagaggcagagtgccctccggatatctgtccggcgccttgctgagtggtggaggtgagggataccagctccgggtgtgcctcttttctctccctggctgccaatcctgattttccctgcagtccccttggtttgtaaattgcctgcatttattctgtcagccaacatgtacaaaatgtaagaaagaatttttaaacaggtaataaattatatttataagcaacaaa

SEQ ID NO: 198164 - DNA, 8662 bp, Homo sapiens
  Payload ID: 19095
  Gene Name: unc-5 netrin receptor D
  ENST ID: ENST00000287272
  CDS Start-End: 21-2675
tccggaacgcggcgaggagcatggggagagcggcggccaccgcaggcggcggcggaggggcgcgccgctggctcccgtggctggggctgtgcttctgggcggcagggaccgcggctgcccgaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtagctgtgggaaaagatgagctatgataatgctgggaaggcagagattgattaagtgcatgctttgaaataggtttttaatgatgtgccccaaagggccagctgattctggtactagattgtcagagttttctaccaactggcatctgtgatgtcagagatcattgtaaaaatggcttttagacgtgaaacagggttgccaacccatttgtatgacttcaacaacgtcaaggagggcatttagaatttagaatctgagcacatcacaccagcaccagctccctgtctcttctagccacttaatggagacacaatggagaggtaagacagaccacaaactagttcttatagtgtactccaccttttacttttttcctgagacaaatctacccttattctttcttcctcttccttaccccttgcagtagggaggtatcaaggagcataattaaacttgtcaatacggaaagttgttttttctaacacaacaaagtgggaccatctctattcccatctaagccactcaaattgctgagtgctattagaacacagcttattacatggatatggggacaggagagattaaagcaggttcaaaaacacatgaactgcagatgccataggcctcaaatcagctgtaattctaggagacacgtgttgatctagttatctaacattgttgttataagaaaatgagtttactgcatttttcaatccagattcttgaaattgtctaacatgtgggtactgtgtcatcacaaaatctctcagtaaggctatatgtgatcctcattttgcctcttgggaaattagcagatagtctttgctctaaatgatatctgagtaaatagacttgaggaatcctctaccacagtgtccctgaaaccacatgcatcattcaggaagccttcaccctgtgactattcagcctccctgaatatgctttctctatagaaccactaacatatggctattgctctatgatttttttttttacattaggaggcagtgatattgtggaagattgaaatccacagataattcatgaccctcatcttatcactttactccatctttttatcctattaaattatttttgacaagatgtcctggtagactaaaggtgaacagatttgctcttgctcatcttctggtggatattttaacttgctattcacaatcaggacaaccaaagtcaaggacccagatgaaccacaaggcagctagtcagctacttagaggttggttacattcgaataaaaagtagtcagggaatgggggaggtggggagttggggagtacttggcagttgggatatgatccatttttttaaacaagttttttgtagatcccttgtaaaataataataataatgttgtgaatctccatgccaagtgaaaaaggcctaaagatgagttgaatttgtgataccatgggtaaggcatggaagaactcttgaatgtgttggccattttctctaactaacatgtggtatgtatggtcccctatattagatagaagtctttgctacatgtaattcaaaagcatctcgcttttctcaggaaccaaaggcttatgatgtaggacaaagaaatcatcttagaactgtcaagcatattttcacaataccatgtcaagatcaggaaaacacccttttgctagtgtgcttaacttatttatttcttctaggaaacaatagataaacagcatgaaaatgtaaatcatctggcatcactgatagaatttctgaaagagaaagagaagtagatggtcaaccagtcactagttggttggcatgaggtggtgtgcagaggaaagctgcattcactattgagtaaaaacttgtagaaagcacattatagagcttatgttggaatccatcttggaggatttttgttttaaactgtctttagcattttccctcttcccttctaatgggcattataattgtttcatctactctgtgaatctacataggtctttttttttagatgtttgatacattttaagtatttttaaatagatgaaaattctaaatgattttccctcaaatctatctagattattttaagatgagacaagattattgtcaatccctgaatgtctggagttacctcccatggatttttttttcctttggcctgggttttataaacaacttgaacatcatatcatataggataacaaaggaggaagttaacttaattcacctcagacttcagcctaagattcaatcaaattcatccttcagcctgtcttgtttcttctttatgtttcttttacttattgctgctaggatcctacataggatttctatagaaatgtatgaaattctgtggtcactgcatgtcaggattgcacagtatgttacaatacaatttcaaagagaacccacatttgtgagatttacagaccaaggtgtggtggaggaggtagaattgcagatcagataaaaagtgagcttacacttgaacttagttattcactgtgacctaaatttagtcctattgtaatatgtgcctgtcacaacacaaatacccctcttgaaagagatttactcatctatccaagcacttaatttggaaattttattgtcctattgcaaaatgaaacaaaattaaaagtggcctcgagtacttggtaagttacttaaaatttttacaaaaatatcccactcaatgccaaatctttcagtcctcaaaggcatttaagtccaatagtcatgctttaaatatggctttaaattatgccaccaaaatggtgcacttcacagattcaccagactgtagcatcataaagttaatttacagtttttacaacattgcttctacattcttactggtttacattaaaatcctttaagccaaaaggaagcttgctctatggatttaaatgcaaacttcatttaccagtgcaggaagtctcataaaactcagatgtactcccacaaaaattttattggcctttttgtaagagatgaaaaagaattgacacagttctctttaaagagaagaacttttttattattatttttatctccaactgcaggtggtgtcttttgccaaggtctctgtatttttctttcagttgtctttgggaggggatgttaagtcaaatcactaaaacagggttctctttggattaaaagttctggatttattgcaactattttccttgagaaacattctcagcatcaggattgataaacaaatgtagatgattaaaataggataattggttttagataatatcttctactgccaaacttctggcaaatttacctgtgaatttcaaaatgttataaaatctcttgatatgcttttgtttttccttttagccattttctcttcaatttcttagtccctctgccctctgtaaatgtgttgagtgatatagctatcagatgtattgaaggcaaagttctcgcagaggtctctgttccagctctgtaaaggtcacaggaatcgtgaaggagctgagaaatcttcctctccggcccactgtctgtggcccattgtcattgtttcctcatgaaacattgcagagtttgaatcctcagtaactctcattgactggattagaggtgatggccacagcaaatgggagagcaaaatgttggcctacagagaatgacacaattttattcgcctttggtgttagttgccatagtgctgtatttgaaaatcgatgctttagccaaaagctgaatgaccaccgtttccgtagtttccactgttttgtctgcatagaattttcctgaactacaagcaaaaatgtattttgtccaatgtcacaaaagtgaaaatgttactaatcttagatgtgttgcatattttgtgtttttacgttccaaactctttcaaaagctgccgttacaaagctgtttggctgtattgacagcatgtggtgtttttacaaaagcaattctaggagagccagtgtctaccatgaactcctgacatccccactccagggtcattcatgacattgaaatggcaacttgtacactgtaattcttcgaaaagtaacaggggatggaaatcagacctggccgttagtcactagtgtgtagtaccgtgatctgaagtaggaaatttaactgacatagaataattgtggtttttgaagcagctactcattgctttttccttttgctgtgaagatcatggattgggaatgtcctcgtgaggtggacctaaggcagtaacatttaaacttcatgtcctagcacccgccctccatctgacccaaagataaaaaaggcatcaagcttcatggttatgcctaagcttaaaaattcccttccccactactaatattgagttcagcagggccccatcttacttatttttcaaaaaagttatagctttgaattatagactatattactaaatttggtaaggtagttctttgcatgaatgggaatgtgtgtcaaaatactttcacaaaaggcatgattacaatggaaatgcccctttgcctccagttttgctaaccctaaaaagtatttcactaatttcaagcactgtttacactcaaatcccaaaattggccaaattatataattctcttaaattttcatttctgtaggtggagatttaactatggttctggtgaatcatagaagggagagacaatatttgaggggagtttatcagcagaatatcatgccttatgaccccattactgaaacacagacattacaatcagaaatagacctaataattccaatatccctccattaactagttccagtgatgctgagagacacagcaccctgtgccaggtatcagaaatataagcctcagcagagggtaactgaaaactttcaatcagaaacactctccaaggcttatggctagattatgtaggtcactaccattcaaaacttttctatacaaaggtggaaaagcactcagaatctgggaattttctggttggaagaacaatgttctccttttccaaattggaataaagactcagaattacccattcttcataatcatgtctgattggtacatacactccaggaagtctcaacctagaaacatttccaacctaagcatttaaaggaaaactggctcattcttctgacccaaactcaaaaaatatgagtacttgcgtacctccatttctgcatgaagattttaaaacagatttcatttttttctgtttattttgggaaggtgcgtgggggtgttctttcaagtgattcacatctcaaacccataccactctcaacttttatttgatgtgttcaaagccaaaaaataaaataaaataaagcagggctgaacacttaatttgacatgaagctgaaggactgagcaagccagaggagagaggttgaatgaagcatagccttggcttcataccacactttttgtgccttgtattatcaatgtaaattctgaatgttgtacagtaaacttggatggacttcttagaaaaggctgcactggcttctttttcagcacatgtacatatctataaatatatatacatatatatttggtaatgccaaacagctctgttatattgtattgaacaaaatggacggtttggatgttttatgtcgagtttgcaaaaaaaaaaaaaaaaaaaaaaactggatggttgcagacttttcaagataaatgtacagacgtaaattactgcatatcagttatttatgaataaagagtcttttattgacattttaggata

SEQ ID NO: 198165 - DNA, 3252 bp, Homo sapiens
  Payload ID: 19095
  Gene Name: unc-5 netrin receptor D
  Uniprot ID: Q6UXZ4
  ENST ID: ENST00000404895
  CDS Start-End: 329-3190
cggactctcgcctccgctccgtagttcggggcccggcagcggcgcgagggctgggaactgcgcggcggggactgcgggcgactccggcatccgcgctggcggcagcggtcgccgcgccgtgggaagctatggggacgcgccctttctcggggtgcccattcagcggcggctcggagctccctgccccgctgctttaggaagcgatcgtggagcagagtcactctctgaagactcccgagacccattcgactcgggaccctcatcgccgaccctttcccgggctcccggagcgtgaagaagagccgccctccggaacgcggcgaggagcatggggagagcggcggccaccgcaggcggcggcggaggggcgcgccgctggctcccgtggctggggctgtgcttctgggcggcagggaccgcggctgcccgaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggccttttgtgagggaatgtcagtgcagaaaataacctgcacttctctttgtcctgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaa

SEQ ID NO: 198166 - DNA, 2966 bp, Homo sapiens
  Payload ID: 19095
  Gene Name: unc-5 netrin receptor D
  ENST ID: ENST00000420357
  CDS Start-End: 21-2681
tccggaacgcggcgaggagcatggggagagcggcggccaccgcaggcggcggcggaggggcgcgccgctggctcccgtggctggggctgtgcttctgggcggcagggaccgcggctgcccgaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctaggcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtag

SEQ ID NO: 198167 - DNA, 7002 bp, Homo sapiens
  Payload ID: 19095
  Gene Name: unc-5 netrin receptor D
  Uniprot ID: Q6UXZ4
  ENST ID: ENST00000453357
  CDS Start-End: 57-2903
ttaaataagtagggattgtttaaaaaaaaaagctgtaatatgttatctgggggtggatgatcctggtgttagttaaagctctcagtgatgtctgtgctgggacttccgggttcctgttggacttttcctcccaaacttcaccaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggccttttgtgagggaatgtcagtgcagaaaataacctgcacttctctttgtcctgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtagctgtgggaaaagatgagctatgataatgctgggaaggcagagattgattaagtgcatgctttgaaataggtttttaatgatgtgccccaaagggccagctgattctggtactagattgtcagagttttctaccaactggcatctgtgatgtcagagatcattgtaaaaatggcttttagacgtgaaacagggttgccaacccatttgtatgacttcaacaacgtcaaggagggcatttagaatttagaatctgagcacatcacaccagcaccagctccctgtctcttctagccacttaatggagacacaatggagaggtaagacagaccacaaactagttcttatagtgtactccaccttttacttttttcctgagacaaatctacccttattctttcttcctcttccttaccccttgcagtagggaggtatcaaggagcataattaaacttgtcaatacggaaagttgttttttctaacacaacaaagtgggaccatctctattcccatctaagccactcaaattgctgagtgctattagaacacagcttattacatggatatggggacaggagagattaaagcaggttcaaaaacacatgaactgcagatgccataggcctcaaatcagctgtaattctaggagacacgtgttgatctagttatctaacattgttgttataagaaaatgagtttactgcatttttcaatccagattcttgaaattgtctaacatgtgggtactgtgtcatcacaaaatctctcagtaaggctatatgtgatcctcattttgcctcttgggaaattagcagatagtctttgctctaaatgatatctgagtaaatagacttgaggaatcctctaccacagtgtccctgaaaccacatgcatcattcaggaagccttcaccctgtgactattcagcctccctgaatatgctttctctatagaaccactaacatatggctattgctctatgatttttttttttacattaggaggcagtgatattgtggaagattgaaatccacagataattcatgaccctcatcttatcactttactccatctttttatcctattaaattatttttgacaagatgtcctggtagactaaaggtgaacagatttgctcttgctcatcttctggtggatattttaacttgctattcacaatcaggacaaccaaagtcaaggacccagatgaaccacaaggcagctagtcagctacttagaggttggttacattcgaataaaaagtagtcagggaatgggggaggtggggagttggggagtacttggcagttgggatatgatccatttttttaaacaagttttttgtagatcccttgtaaaataataataataatgttgtgaatctccatgccaagtgaaaaaggcctaaagatgagttgaatttgtgataccatgggtaaggcatggaagaactcttgaatgtgttggccattttctctaactaacatgtggtatgtatggtcccctatattagatagaagtctttgctacatgtaattcaaaagcatctcgcttttctcaggaaccaaaggcttatgatgtaggacaaagaaatcatcttagaactgtcaagcatattttcacaataccatgtcaagatcaggaaaacacccttttgctagtgtgcttaacttatttatttcttctaggaaacaatagataaacagcatgaaaatgtaaatcatctggcatcactgatagaatttctgaaagagaaagagaagtagatggtcaaccagtcactagttggttggcatgaggtggtgtgcagaggaaagctgcattcactattgagtaaaaacttgtagaaagcacattatagagcttatgttggaatccatcttggaggatttttgttttaaactgtctttagcattttccctcttcccttctaatgggcattataattgtttcatctactctgtgaatctacataggtctttttttttagatgtttgatacattttaagtatttttaaatagatgaaaattctaaatgattttccctcaaatctatctagattattttaagatgagacaagattattgtcaatccctgaatgtctggagttacctcccatggatttttttttcctttggcctgggttttataaacaacttgaacatcatatcatataggataacaaaggaggaagttaacttaattcacctcagacttcagcctaagattcaatcaaattcatccttcagcctgtcttgtttcttctttatgtttcttttacttattgctgctaggatcctacataggatttctatagaaatgtatgaaattctgtggtcactgcatgtcaggattgcacagtatgttacaatacaatttcaaagagaacccacatttgtgagatttacagaccaaggtgtggtggaggaggtagaattgcagatcagataaaaagtgagcttacacttgaacttagttattcactgtgacctaaatttagtcctattgtaatatgtgcctgtcacaacacaaatacccctcttgaaagagatttactcatctatccaagcacttaatttggaaattttattgtcctattgcaaaatgaaacaaaattaaaagtggcctcgagtacttggtaagttacttaaaatttttacaaaaatatcccactcaatgccaaatctttcagtcctcaaaggcatttaagtccaatagtcatgctttaaatatggctttaaattatgccaccaaaatggtgcacttcacagattcaccagactgtagcatcataaagttaatttacagtttttacaacattgcttctacattcttactggtttacattaaaatcctttaagccaaaaggaagcttgctctatggatttaaatgcaaacttcatttaccagtgcaggaagtctcataaaactcagatgtactcccacaaaaattttattggcctttttgtaagagatgaaaaagaattgacacagttctctttaaagagaagaacttttttattattatttttatctccaactgcaggtggtgtcttttgccaaggtctctgtatttttctttcagttgtctttgggaggggatgttaagtcaaatcactaaaacagggttctctttggattaaaagttctggatttattgcaactattttccttgagaaacattctcagcatcaggattgataaacaaatgtagatgattaaaataggataattggttttagataatatcttctactgccaaacttctggcaaatttacctgtgaatttcaaaatgttataaaatctcttgatatgcttttgtttttccttttagccattttctcttcaatttcttagtccctctgccctctgtaaatgtgttgagtgatatagctatcagatgtattgaaggcaaagttctcgcagaggtctctgttccagctctgtaaaggtcacaggaatcgtgaaggagctgagaaatcttcctctccggcccactgtctgtggcccattgtcattgtttcctcatgaaacattgcagagtttgaatcctcagtaactctcattgactggattagaggtgatggccacagcaaatgggagagcaaaatgttggcctacagagaatgacacaattttattcgcctttggtgttagttgccatagtgctgtatttgaaaatcgatgctttagccaaaagctgaatgaccaccgtttccgtagtttccactgttttgtctgcatagaattttcctgaactacaagcaaaaatgtattttgtccaatgtcacaaaagtgaaaatgttactaatctt

SEQ ID NO: 198168 - DNA, 2448 bp, Homo sapiens
  Payload ID: 19095
  Gene Name: unc-5 netrin receptor D
  ENST ID: ENST00000449677
  CDS Start-End: 112-1701
ttgcctacacttaaactcaacttatgtgtattgtaaatctctaagacaatattagtcttaccaaacttacctgaccattttgttttatttttatttttagccaagaatatcatggaactaatgatacaagaaaaatcctttggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtagctgtgggaaaagatgagctatgataatgctgggaaggcagagattgattaagtgcatgctttgaaataggtttttaatgatgtgccccaaagggccagctgattctggtactagattgtcagagttttctaccaactggcatctgtgatgtcagagatcattgtaaaaatggcttttagacgtgaaacagggttgccaacccatttgtatgacttcaacaacgtcaaggagggcatttagaatttagaatctgagcacatcacaccagcaccagctccctgtctcttctagccacttaatggagacacaatggagaggtaagacagaccacaaactagttcttatagtgtactccaccttttacttttttcctgagacaaatctacccttattctttcttcctcttccttaccccttgcagtagggaggtatcaaggagcataattaaacttgtcaatacgg

SEQ ID NO: 198169 - DNA, 3532 bp, Homo sapiens
  Payload ID: 19095
  Gene Name: unc-5 netrin receptor D
  ENST ID: ENST00000416672
  CDS Start-End: 11-2887
ggcgaggagcatggggagagcggcggccaccgcaggcggcggcggaggggcgcgccgctggctcccgtggctggggctgtgcttctgggcggcagggaccgcggctgcccgaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggccttttgtgagggaatgtcagtgcagaaaataacctgcacttctctttgtcctgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagatggagtaggagaggcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtagctgtgggaaaagatgagctatgataatgctgggaaggcagagattgattaagtgcatgctttgaaataggtttttaatgatgtgccccaaagggccagctgattctggtactagattgtcagagttttctaccaactggcatctgtgatgtcagagatcattgtaaaaatggcttttagacgtgaaacagggttgccaacccatttgtatgacttcaacaacgtcaaggagggcatttagaatttagaatctgagcacatcacaccagcaccagctccctgtctcttctagccacttaatggagacacaatggagaggtaagacagaccacaaactagttcttatagtgtactccacctt

SEQ ID NO: 198170 - DNA, 1143 bp, Homo sapiens
  Payload ID: 19096
  Gene Name: unc-50 homolog (C. elegans)
  Uniprot ID: Q53HI1
  ENST ID: ENST00000357765
  CDS Start-End: 153-932
ggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaa

SEQ ID NO: 198171 - DNA, 613 bp, Homo sapiens
  Payload ID: 19096
  Gene Name: unc-50 homolog (C. elegans)
  ENST ID: ENST00000393493
  CDS Start-End: 1-386
ggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgtttggattcctttcttttccagcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaa

SEQ ID NO: 198172 - DNA, 1276 bp, Homo sapiens
  Payload ID: 19096
  Gene Name: unc-50 homolog (C. elegans)
  ENST ID: ENST00000409347
  CDS Start-End: 235-1065
ggcccctcggccggcgatagagttgcggctaaaatgaaaggacgcccagttacatttgcatcgtagataaagaaagagcatttagtataagcatgtccgaaatgttgcgtgggatgtaggcatactaaaaccttattcgtggcctgtctgaaatccaaatggagctggggttgggaagaacatggaaagtgacctccctgccaaataactcagaagaggagtgtcggtagccaaatgtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaa

SEQ ID NO: 198173 - DNA, 2172 bp, Homo sapiens
  Payload ID: 19096
  Gene Name: unc-50 homolog (C. elegans)
  ENST ID: ENST00000409975
  CDS Start-End: 1131-1961
ggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggtgaggcctgaggaccactctgccctcccgcggcccgggctcgcgccgggggccatttaatcccgacagcttgcggcctgacgtcgctgcggcctggcagtgaccatgtcggcgtccggcccctcggccggcgatagagttgcggctaaaatgaaaggacgcccagttacatttgcatcgtagataaagaaagagcatttagtataagcatgtccgaaatgttgcgtgggatgtaggcatactaaaaccttattcgtggcctgtctgaaatccaaatggagctgggtattctgtgtttttatttgctaaatctggcagccgtacccgcggccccgggcagggagggagcagctgggctcggccagaccctgccggcgtctggggggcctgcgaagtggaggggagacgggcagccgggcagtggccggcgttccccggagctcggaccggttggattggactccgacgctaccgctccctctgctgaactattccggatgtaaaacactagggatcggagtttttcttggttttttaatctcattctagtgaccgagaagcttgctggcagtgcgctgatggatctgtgtgaataggccatttatttgacctcttcagtaacactgttctaaccggctgaaactgctttcttaggcattttcttaaaagcttggtggttaagagcacggaatttcgagtcagatttccaatcttggctctatcactatcctcggagtcatggggcagtcacatcatccctgtctctgtaatggtagctgcccctggataagtgttattaggtgattcagaagggtgggctgttgcccttgcctgaggttgcagtctgcggttcccaagccccaagacccgcctcagaactaactgcatttgcttttgactcctggcctttctctagggttgggaagaacatggaaagtgacctccctgccaaataactcagaagaggagtgtcggtagccaaatgtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaa

SEQ ID NO: 198174 - DNA, 489 bp, Homo sapiens
  Payload ID: 19096
  Gene Name: unc-50 homolog (C. elegans)
  ENST ID: ENST00000423713
  CDS Start-End: 1-278
ggttcatctctaacaagtatttagtgaaacgacagagcagagactatgatgtggaatggggctatgcttttgatgtgcatctcaatgctttttatccactcctggtcattttgcattttatccagctttttttcatcaacccattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaa

SEQ ID NO: 198175 - DNA, 5310 bp, Homo sapiens
  Payload ID: 19097
  Gene Name: unc-51 like autophagy activating kinase 1
  Uniprot ID: O75385
  ENST ID: ENST00000321867
  CDS Start-End: 352-3504
gaggcccgggcgccgcggctcttttgtttctccgttggggccgagcccgggccctagttggagccggagtcggagtcggagtcggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtgcctgacggggaaggcgcccttccaggccagcagcccccaggacctgcgcctgttctacgagaagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtgacctggtggctgaggcgcccagtgccaaacccccgccagacagcctgatgtgcagtgggagctcactggtggcctctgcgggcttggagagccacggccggaccccatctccatccccaccctgcagcagctcccccagtccctcaggccgggctggcccgttctccagcagcaggtgcggcgcctctgtccccatcccagtccccacgcaggtgcagaactaccagcgcattgagcgaaacctgcagtcacccacccagttccaaacacctcggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaagttggaaccatccctgagcggccaggctggagcgggacgccctccccacagggagctgagatgcggggtggcaggtcccctcgtccaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtctttcagcaccagccgcctcactgacctgctccttaaggcggcgtttgggacacaagccccggacccgggcagcacggagagcctgcaggagaagcccatggagatcgcaccctcagctggctttggagggagcctgcacccaggagcccgtgctgggggcaccagcagcccttccccggtggtcttcaccgtgggctctcccccgagcgggagcacgcccccccagggcccccgcaccaggatgttctcagcgggccccactggctctgccagctcttctgcccgccacctggtgcctgggccctgcagcgaggccccagcccctgagctccctgctccaggacacggctgcagctttgccgaccccattactgcgaacctggagggggctgtgaccttcgaggcccccgacctccctgaggagaccctcatggagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatggggcttcgcggaacagctggtgctgtacctgaaggtggccgagctactgtcctccggcctgcaaagtgccatcgaccagatccgggccggcaagctctgcctgtcgtccactgtgaagcaggtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggaaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcatctgcagagaggcctgccttccggattccaggcgggcatgccctgcaaaccccgcctgggcctcccttggtctgcccagccctcgattagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtcaccact

SEQ ID NO: 198176 - DNA, 3908 bp, Homo sapiens
  Payload ID: 19098
  Gene Name: unc-51 like autophagy activating kinase 2
  Uniprot ID: Q8IYT8
  ENST ID: ENST00000361658
  CDS Start-End: 520-3630
agtcgcgcgggagcgggtagcgcgcgcgagggcgttgggcgccgccgcgaggcggggaagcgcggggccgcggcggtgcgggttctagggcggcggccgtcgccgtcgcagcagcgccccgagcggggagggccgaggaggcccgacgagctggggatggagagtaccgggcccctcactgcctcagagcgcgtgtgcggctctgggcgcgcacagtgacggtgacggcacccctggcccggcagcgccgaggccgcttcgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccgtggtcttccgggggcggcaccgccagaaaactgattgggaggtagctattaaaagtattaataaaaagaacttgtcaaaatcacaaatactgcttggaaaggaaattaaaatcttaaaggaacttcagcatgaaaatattgtagcactctatgatgttcaggaattacccaactctgtctttttggtgatggagtattgcaatggtggagacctcgcagattatttgcaagcgaaagggactctcagtgaagacacgatcagagtgtttctgcatcagattgctgctgccatgcgaatcctgcacagcaaaggaatcatccacagagatctcaaaccacagaacatcttgctgtcctatgccaatcgcagaaaatcaagtgtcagtggtattcgcatcaaaatagcggattttggttttgctcgttacctacatagtaacatgatggctgcaacactgtgtggatccccgatgtacatggctcctgaggttattatgtctcaacattatgatgctaaggctgacttgtggagcataggaacagtgatataccaatgcctagttggaaaaccaccttttcaggccaatagtcctcaagacttaaggatgttttatgaaaaaaacaggagcttaatgcctagtattcccagagaaacatcaccttatttggctaatctccttttgggtttgcttcagagaaaccaaaaagatagaatggactttgaagcattttttagccatccttttcttgagcaaggtccagtaaaaaaatcttgcccagttccagtgcccatgtattctggttctgtctctggaagctcctgtggcagctctccatcttgtcgttttgcttctccaccatcccttccagatatgcagcatattcaggaagaaaacttatcttccccaccattgggtcctcccaactatctacaagtttccaaagattctgccagtactagtagcaagaactcttcttgtgacacggatgactttgttttggtgccacacaacatctcgtcagaccactcatgtgatatgccagtggggactgctggcagacgtgcttcaaatgaattcttggtgtgtggagggcagtgtcagcctactgtgtcacctcacagcgaaacagcaccaattccagttcctactcaaataaggaattatcagcgcatagagcagaatcttacatctactgccagctcaggcacaaatgtacatggttctccaagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagctccggcaggagcctgtggtggtgttctggcacctcctgcaggtacagcagcaagttccaaggctgtcctcttcactgtagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgtgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatataaatgtagtattgagagaagactgtcggcgctctgccatagcaccgcaaccgtgtgagcagcaggctcatcccgtggaccggtggtgggaacgtgaggaagaggggaaggaaggaagagcttttccatttggtgctccaatgtctcctgctggacccatctgcctagtggaaggcagcaaaatttcaagaaacaggtgaggttgagcagcttggtgcaaccccatggggcctggagttggagctcaacagcaatggatttcagagaccaccctgaaactcccagtaaaaaagacttgggagacatgttaataaactcaagcatttgatcgaccca

SEQ ID NO: 198177 - DNA, 6010 bp, Homo sapiens
  Payload ID: 19098
  Gene Name: unc-51 like autophagy activating kinase 2
  Uniprot ID: Q8IYT8
  ENST ID: ENST00000395544
  CDS Start-End: 501-3611
gcgcgcgcgagggcgttgggcgccgccgcgaggcggggaagcgcggggccgcggcggtgcgggttctagggcggcggccgtcgccgtcgcagcagcgccccgagcggggagggccgaggaggcccgacgagctggggatggagagtaccgggcccctcactgcctcagagcgcgtgtgcggctctgggcgcgcacagtgacggtgacggcacccctggcccggcagcgccgaggccgcttcgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccgtggtcttccgggggcggcaccgccagaaaactgattgggaggtagctattaaaagtattaataaaaagaacttgtcaaaatcacaaatactgcttggaaaggaaattaaaatcttaaaggaacttcagcatgaaaatattgtagcactctatgatgttcaggaattacccaactctgtctttttggtgatggagtattgcaatggtggagacctcgcagattatttgcaagcgaaagggactctcagtgaagacacgatcagagtgtttctgcatcagattgctgctgccatgcgaatcctgcacagcaaaggaatcatccacagagatctcaaaccacagaacatcttgctgtcctatgccaatcgcagaaaatcaagtgtcagtggtattcgcatcaaaatagcggattttggttttgctcgttacctacatagtaacatgatggctgcaacactgtgtggatccccgatgtacatggctcctgaggttattatgtctcaacattatgatgctaaggctgacttgtggagcataggaacagtgatataccaatgcctagttggaaaaccaccttttcaggccaatagtcctcaagacttaaggatgttttatgaaaaaaacaggagcttaatgcctagtattcccagagaaacatcaccttatttggctaatctccttttgggtttgcttcagagaaaccaaaaagatagaatggactttgaagcattttttagccatccttttcttgagcaaggtccagtaaaaaaatcttgcccagttccagtgcccatgtattctggttctgtctctggaagctcctgtggcagctctccatcttgtcgttttgcttctccaccatcccttccagatatgcagcatattcaggaagaaaacttatcttccccaccattgggtcctcccaactatctacaagtttccaaagattctgccagtactagtagcaagaactcttcttgtgacacggatgactttgttttggtgccacacaacatctcgtcagaccactcatgtgatatgccagtggggactgctggcagacgtgcttcaaatgaattcttggtgtgtggagggcagtgtcagcctactgtgtcacctcacagcgaaacagcaccaattccagttcctactcaaataaggaattatcagcgcatagagcagaatcttacatctactgccagctcaggcacaaatgtacatggttctccaagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagctccggcaggagcctgtggtggtgttctggcacctcctgcaggtacagcagcaagttccaaggctgtcctcttcactgtagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgtgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatataaatgtagtattgagagaagactgtcggcgctctgccatagcaccgcaaccgtgtgagcagcaggctcatcccgtggaccggtggtgggaacgtgaggtgatgcctttgggattacagcttgagttctgtcaccccatccccaggaaactgtagcttcttaactggtgactaccaaagaacaagcagtgatttgaaaaaggaaaaacaatccaaaaactacatatttgtaggaaatctgccttattggagaaaatcaccctttccctttttctttgtagaagcaggagcaagagtgtttggctcccagtttggacttggtgaataaatgtaccttagaactaggataatcggtacagttattcttaaagataattaaaaatgaaacaaagtgagtgctcgtcactgggttcatcagagcagtgtgtgaaattccatgtgtttgctgaggtgtaaaggtaaatgtattcacccctcatccaggcagtttgatatttggagtaagtttgtttaaatctgagcatgcatctttaaacagctcaggaagaaatagcttaagaagaagtgaaacatggatcttggaagaaattttgaaatcttcaatttgatcctaatatggatacatgttaatcttccaaaatctttcatattgcactaatttattaaaacaactgtgtattggattttgtaatttaactaaggcacaatggacttgtttaaaatattttacttgattgtatacatagaccctttccagaattcacatgtaatctccagtgaacttttaagtggttaaaacttgtattcatgtgaacctttgcacattttttttttttacttctttatctacacctacagattttctcagtaatgtttttgttagcttttggttccattttttattgtgcatgcagaatgtacattgatgcctgtgaccttaggtttattaaaggctaggtttatttgggcagtattagaaacaaaatcatggatcaagagatactcttgataatttgaatagggccaaaacaaagttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattacttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttttcctttactttgacaaagtaatgtaatttttaccttatttatctgtatgaaattccagtagttaatttgaacatttatttatatgacgtttgtatttttaggtctttaatacagtgtttctacctctcatttgtaactgcatgcattattcttgaaactaggtaaaactcactgaattgttgtgtaatagcctttttattattgcctgtacaaatgtatattaaggtaaaataaaactgacaaagtgtttctagggtgtagctgggtacatattaagtggcttgttgagccaggtacttccttagtgagtttagagacttggccatgaatatcctttgtcctgccccaggatttagatcttggctactgtcatgcaggcttccaggaacatagactgttttacctccacaaccctatttgttattagtgatactttattttatataatattttttattcacagtgaaatttcattcatgttctttcagttatcacctgtgttatctcagttgtaggtttattctatcctctcctcttcctctcccatttcttttttaagacaggatgaaacaggttcagagaggggaagtgattggcctaaagtcaggaactaggcaagtggtcaagccatgctttgtgactttcaagttaattcttcttgttcttgtatattaaaggtcttggggtagatggtgtgtgtgaaacagtgaagtctcaacagcagaaaagaacaaaatgtaaattcatgaataatggttctggttatacttccattatcaaggctaattaagagattttgccttgagtatagcaataataaacaaatgctttatgtttccctgagtatttttaaatttcatatcgtgtttcatagagtggaaatgtaccagttcatacattcatgggttgacacctgtattcaagccataacctggaaaattgctgaccagctattcctgctctaagggtttgctttaactataccctccactggactatatatagagagagagcctatgctgtatatagttggtttcccacagtc

SEQ ID NO: 198178 - DNA, 594 bp, Homo sapiens
  Payload ID: 19098
  Gene Name: unc-51 like autophagy activating kinase 2
  ENST ID: ENST00000575432
  CDS Start-End: 1-594
ggccgagcagcagagcaaggcagtgtttggcagatctgtcagtaccgggaagttatcagatcaacaaggaaagactcctatatgtcgacatcagggcagcacagacagtttaaatacagaacgaccaatggatatagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggg

SEQ ID NO: 198179 - DNA, 564 bp, Homo sapiens
  Payload ID: 19098
  Gene Name: unc-51 like autophagy activating kinase 2
  ENST ID: ENST00000574732
  CDS Start-End: 1-64
ttatttgcaaggttatatagaacatattctaagaattatatggacagacatgcatcacgaataatttaaataggtacatggatactaaatcctcagtgtagcgaaagggactctcagtgaagacacgatcagagtgtttctgcatcagattgctgctgccatgcgaatcctgcacagcaaaggaatcatccacagagatctcaaaccacagaacatcttgctgtcctatgccaatcgcagaaaatcaagtgtcagtggtattcgcatcaaaatagcggattttggttttgctcgttacctacatagtaacatgatggctgcaacactgtgtggatccccgatgtacatggctcctgaggttattatgtctcaacattatgatgctaaggctgacttgtggagcataggaacagtgatataccaatgcctagttggaaaaccaccttttcaggccaatagtcctcaagacttaaggatgttttatgaaaaaaacaggagcttaatgcctagtattcccagagaaacatcaccttatttggctaatctccttttgggtttgcttca

SEQ ID NO: 198180 - DNA, 577 bp, Homo sapiens
  Payload ID: 19098
  Gene Name: unc-51 like autophagy activating kinase 2
  ENST ID: ENST00000580118
  CDS Start-End: 1-148
gcatgaaaatattgtagcactctatgatgttcagtcttgctcttgtcgcccagggtggagtgcaatggcacaatctcagctcattgcacctctgcctcctgagttcaagggattctcctgcctcagcctcctgaatagctgggattaaggaattacccaactctgtctttttggtgatggagtattgcaatggtggagacctcgcagattatttgcaagcgaaagggactctcagtgaagacacgatcagagtgtttctgcatcagattgctgctgccatgcgaatcctgcacagcaaaggaatcatccacagagatctcaaaccacagaacatcttgctgtcctatgccaatcgcagaaaatcaagtgtcagtggtattcgcatcaaaatagcggattttggttttgctcgttacctacatagtaacatgatggctgcaacactgtgtggatccccgatgtacatggctcctgaggttattatgtctcaacattatgatgctaaggctgacttgtggagcataggaacagtgatataccaatgcctagttggaaaaccaccttttcaggccaatag

SEQ ID NO: 198181 - DNA, 2623 bp, Homo sapiens
  Payload ID: 19099
  Gene Name: unc-51 like kinase 3
  Uniprot ID: Q6PHR2
  ENST ID: ENST00000440863
  CDS Start-End: 93-1511
gcgtggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgcccctggcctgcccttcccgggaccccttattccaactcagctcctctttgcactggaatggggcactccaacacccctcagggaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtaaagagtatcattcattgtttctctattaaattattttctctatt

SEQ ID NO: 198182 - DNA, 1711 bp, Homo sapiens
  Payload ID: 19099
  Gene Name: unc-51 like kinase 3
  ENST ID: ENST00000568273
  CDS Start-End: 4-156
agaatgcaaagaaatggatcagctagccgagggttggagaagaccaggctgaggctgtgtcgggaagccaggattccagaatcagcattcctcactggcctcacaagggaaagctgggaagcccggtgctggtgtgcagtagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaaga

SEQ ID NO: 198183 - DNA, 539 bp, Homo sapiens
  Payload ID: 19099
  Gene Name: unc-51 like kinase 3
  ENST ID: ENST00000568679
  CDS Start-End: 20-145
gcgggcgcaggcggccggaatggcggggcccggctggggtcccccgcgcctggacggcttcatcctcaccgagcgcctgggcagcggcacgtacgccacggtgtacaaggcctacgccaagaatgcaaagaaatggatcagctagccgagggttggagaagaccaggctgaggctgtgtcgggaagccaggattccagaatcagcattcctcactggcctcacaagggaaagctgggaagcccggtgctggtgtgcagtagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaatt

SEQ ID NO: 198184 - DNA, 1633 bp, Homo sapiens
  Payload ID: 19099
  Gene Name: unc-51 like kinase 3
  ENST ID: ENST00000566631
  CDS Start-End: 37-291
agcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacct

SEQ ID NO: 198185 - DNA, 2611 bp, Homo sapiens
  Payload ID: 19099
  Gene Name: unc-51 like kinase 3
  Uniprot ID: Q6PHR2
  ENST ID: ENST00000569437
  CDS Start-End: 89-1501
ggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgcccctggcctgcccttcccgggaccccttattccaactcagctcctctttgcactggaatggggcactccaacacccctcagggaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtaaagagtatcattcattgtttctctattaaattattttctcta

SEQ ID NO: 198186 - DNA, 1717 bp, Homo sapiens
  Payload ID: 19099
  Gene Name: unc-51 like kinase 3
  ENST ID: ENST00000568210
  CDS Start-End: 4-156
agaatgcaaagaaatggatcagctagccgagggttggagaagaccaggctgaggctgtgtcgggaagccaggattccagaatcagcattcctcactggcctcacaagggaaagctgggaagcccggtgctggtgtgcagtagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactc

SEQ ID NO: 198187 - DNA, 561 bp, Homo sapiens
  Payload ID: 19099
  Gene Name: unc-51 like kinase 3
  ENST ID: ENST00000562161
  CDS Start-End: 4-189
agaatgcaaagaaatggatcagctagccgagggttggagaagaccaggctgaggctgtgtcgggaagccaggattccagaatcagcattcctcactggcctcacaagggaaagctgggaagcccggtgctggtgtgcagcagagtccccaaatctcctgtctcgcagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccc

SEQ ID NO: 198188 - DNA, 884 bp, Homo sapiens
  Payload ID: 19099
  Gene Name: unc-51 like kinase 3
  ENST ID: ENST00000563301
  CDS Start-End: 20-430
gcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctcccttccacagaagccctcttcgggcagcccccctttgcctccaggtcgttctcggagctggaagagaagatccgtagcaaccggg

SEQ ID NO: 198189 - DNA, 567 bp, Homo sapiens
  Payload ID: 19099
  Gene Name: unc-51 like kinase 3
  ENST ID: ENST00000565790
  CDS Start-End: 26-154
atgcctctgccgggagcactccagaatgcaaagaaatggatcagctagccgagggttggagaagaccaggctgaggctgtgtcgggaagccaggattccagaatcagcattcctcactggcctcacaagggaaagctgggaagcccggtgctgaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtg

SEQ ID NO: 198190 - DNA, 1470 bp, Homo sapiens
  Payload ID: 19099
  Gene Name: unc-51 like kinase 3
  Uniprot ID: Q6PHR2
  ENST ID: ENST00000568667
  CDS Start-End: 4-1455
agaatgcaaagaaatggatcagctagccgagggttggagaagaccaggctgaggctgtgtcgggaagccaggattccagaatcagcattcctcactggcctcacaagggaaagctgggaagcccggtgctggtgtgcaaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgat

SEQ ID NO: 198191 - DNA, 561 bp, Homo sapiens
  Payload ID: 19099
  Gene Name: unc-51 like kinase 3
  ENST ID: ENST00000565373
  CDS Start-End: 4-153
agaatgcaaagaaatggatcagctagccgagggttggagaagaccaggctgaggctgtgtcgggaagccaggattccagaatcagcattcctcactggcctcacaagggaaagctgggaagcccggtgctggtgtgcagtaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtgg

SEQ ID NO: 198192 - DNA, 126 bp, Homo sapiens
  Payload ID: 19099
  Gene Name: unc-51 like kinase 3
  ENST ID: ENST00000631115
  CDS Start-End: 1-126
atggcggggcccggctggggtcccccgcgcctggacggcttcatcctcaccgagcgcctgggcagcggcacgtacgccacggtgtacaaggcctacgccaagaatgcaaagaaatggatcagctag

SEQ ID NO: 198193 - DNA, 4613 bp, Homo sapiens
  Payload ID: 19100
  Gene Name: unc-51 like kinase 4
  Uniprot ID: Q96C45
  ENST ID: ENST00000301831
  CDS Start-End: 464-4291
atagagggatggtgggccgaccactatgactgttactccagcacttcccgccccagtctctggcctgtgggctcgtccaaaggcagggcgtgatgccctttgggtggagggaggggccctcgtggtctctcacttccgggccccagccaacaggaacggaaactgcacagccagtcggcttcctgagcttcttccggcgttctgtgtgctgccgtggaaaccgtatggacgaatccaaacctggaggggcgtcgcctccgtaaggctggtcggcttcttccgcgcgttccgctttgcttcactgctttctcccccattcttgggcctgtggacctgtcctgaggcagaggccgagatgcgcgcaaccgcgggagcagccaagtggactggactcttttcttgacttagctaccaggagctagagatgctgttattctattgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacagctgagctccaggaaaatacacctgttgttgaggcaattgttctcttaactgaattaattagggaaaacttcaggaacagcaaattaaaacagtgccttttaccaacccttggggagctgatctatcttgtagccacccaggaagaaaaaaaaaagaaccctagagagtgctgggctgttcccttggctgcatacacagtgctaatgaggtgccttcgggaaggggaagagcgtgttgtgaatcacatggcagcaaaaattattgaaaatgtctgtaccaccttttctgctcagtcccagggctttattacaggagaaataggacccattttgtggtacctattcagacactccactgctgattctcttaggataacagcagtatcggccttgtgtagaatcactcgccattctcctactgccttccagaatgttattgaaaaggtgggactgaactcagtaataaactccctggcctctgccatctgcaaagttcagcagtacatgttgaccttattcgctgccatgttgtcctgtgggattcatcttcaaagactaatccaagaaaagggttttgtctccacaattatccgtttacttgacagcccctcaacatgcattagagcaaaagccttcctggttcttctatatattttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggactgacagcatcagaagaatttatcaagatcacattgtcagcttttgaagcaataatacagtatcctattttattgaaagactatcgctccacggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaagacttgtggaagaaagcaaactgatcccactcatttttgaagtaactctggaacatcaggagagcattctgggtaataccatgcaaagtgtgattgcattactcagcaatctagttgcctgcaaagattcgaatatggaactactttatgaacaaggacttgtcagtcacatctgtaacctgctcactgaaactgccacactgtgcttggatgtggacaataaaaacaacaatgagatggcagctccactgctcttttccctgcttgatattttgcacagcatgctgacctatacctccggtattgtacggctggctttgcaggcccagaagtctggctcaggagaggaccctcaggctgcagaagacctgctgctgctcaacagacctctgacagacctgattagcctgctcattccactgcttcctaatgaagatcctgagatttttgatgtttcatccaagtgcctgtctatactggttcagctgtatggaggggaaaacccggacagcctctctcctgaaaatgtggaaatttttgctcatttactgacatccaaggaggacccaaaggagcagaagcttctgttaaggattctcagaagaatgatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccagaacctggtggcccaagtgctcactaaccccagggcctagaaaactgactcagaatggacttccttggttcctgtggaatgcatctgggaagcccaggtttgttagctgttctcagaaatgttctttccctctctgtgtgggccaggtgggctaaggttagcactgcctgtggtaataaagcagtggatgc

SEQ ID NO: 198194 - DNA, 465 bp, Homo sapiens
  Payload ID: 19100
  Gene Name: unc-51 like kinase 4
  ENST ID: ENST00000431379
  CDS Start-End: 136-390
tggacctgtcctgaggcagaggccgagatgcgcgcaaccgcgggagcagccaagtggactggactcttttcttgacttagctaccaggagctagagatgctgttattctattgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggacaggattatggttgattacttccatggatgtacacatggacaaggtggttccttaaaaacagttattgctcaagatgaaaacctcccaga

SEQ ID NO: 198195 - DNA, 647 bp, Homo sapiens
  Payload ID: 19100
  Gene Name: unc-51 like kinase 4
  ENST ID: ENST00000414606
  CDS Start-End: 164-418
actgctttctcccccattcttgggcctgtggacctgtcctgaggcagaggccgagatgcgcgcaaccgcgggagcagccaagtggactggactcttttcttgacttagctaccaggagctagagatgctgttattctattgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggacaggattatggttgattacttccatggatgtacacatggacaaggttatcaagacacagtcctggaattagttttttgcttcagctgttgtttctgatctctgaccagatgtaatatcctaactgtaaaacatgcctacgtttgtaactgcacgtcacccaccaaaacaaaataaaaccccaaatacctcttcccttcatcatagtaattcatattcaacttttcaatgccagcagaaacttta

SEQ ID NO: 198196 - DNA, 577 bp, Homo sapiens
  Payload ID: 19100
  Gene Name: unc-51 like kinase 4
  ENST ID: ENST00000453224
  CDS Start-End: 149-403
attcttgggcctgtggacctgtcctgaggcagaggccgagatgcgcgcaaccgcgggagcagccaagtggactggactcttttcttgacttagctaccaggagctagagatgctgttattctattgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggacaggattatggttgattacttccatggatgtacacatggacaaggttatcaagacacagtcctggaattagttttttgcttcagctgttgtttctgatctctgaccagatgtggttccttaaaaacagttattgctcaagatgaaaacctcccagaagatgttgtgagagaatttggaattgacctgat

SEQ ID NO: 198197 - DNA, 1904 bp, Homo sapiens
  Payload ID: 19100
  Gene Name: unc-51 like kinase 4
  ENST ID: ENST00000420927
  CDS Start-End: 118-1860
agtagctacgagtctgagttcgtgtctgcctaagcggtcgcggaagagcgcgcaggcctgccggggcgggagctagagatgctgttattctattgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacagctgagctccaggaaaatacacctgttgttgagactacaagctccattggaatcgggattttgaactgtcttgttcaacactccactccagtgcctagacagtgccttgtgtatgtatagatactgacaaatatttcaaaataaataaaactgtatcagcattc

SEQ ID NO: 198198 - DNA, 8400 bp, Homo sapiens
  Payload ID: 19101
  Gene Name: unc-79 homolog (C. elegans)
  Uniprot ID: Q9P2D8
  ENST ID: ENST00000256339
  CDS Start-End: 656-8032
atttttgctcgtcggctgggagccgggcgtcgggtcgctgggagtttgcctcttgtggcagcatcctgcttagtccagcgaattgtgacacattattaaatgtatcagaatataagaactgtgtcactactacgtcaccagatggccatttccacgaattcatgtttccgttcggcggccggcgtccctcgggtggtcgcatgcaatgagtgcatctttctcgagaacaactcttccgcggaaagtcattgctgacagtcctggcattccggtggctgcttcttggcagtgagcacttgtctatcttgcttccaagatccggtacttgcaggaatatcataaccgggttctccacaacatttatcctgtaccatcaggaacagatattgcaaacaccttgaaatacttttctcagaccttgttaagcgtcctgcgagatgctccctcagaacgcggcccgcaaagtcgtgatgctcagttgtcagactacccttctttggactaccaaggcctctacgtgactttggtgaccctcctggatctagttcctttactacagcacggccaacacgatcttggacagtcgatattttatacaactacatgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagtgtatcattgtcaattactggaatgcctcatgaaatataaacaagaagtctggaaagatcttttgtatgtgattgcgtatgggccttcacaagtgaagcctccagctgtgcaaatgcttttccactactggcccaatttaaaacctcctggggcaataagcgagtacagggggttgcagtacacagcttggaatcccatccactgccagcacattgaatgccacaatgcaattaacaaaccagctgtgaagatgtgtatagacccttccctgtcagtagcgttgggtgataaaccacccccgttgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggcctctcctcttcccaccattccctggataatgctgactttgataacaaggacgatgataaacacgatcagaggctgctcagtcaattcggaatatggttcttagtgagcctctgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtgagtgttgcctctgatcctggccgacgagttcagcacaatatgcttagtccatttcatagtcctttccagagtccgtttcggagtcctttgcgtagtccgtttcgtagccctttcaagaattttggacacccaggaggaaggactattgactttgattgtgaagatgatgaaatgaatctaaattgtttcatcctcatgtttgatcttctcctgaagcagatggagttacaagatgatggaatcacgatgggtttagagcacagcttatcaaaggacattatttctattataaacaatgtcttccaagccccctgggggggatcccacacctgccagaaggacgaaaaagcaatcgagtgcaacttatgtcagtctagtatcctctgctatcagcttgcttgtgaactcctggagagactagctcctaaagaagaaagccggctggtggagcccacagacagcctggaggatagcctcctttcttccagaccagagtttatcataggccctgaaggggaggaggaggagaatcctgcaagcaagcatggggagaacccaggcaactgcaccgagcccgtggaacatgctgcagtaaagaatgataccgaaagaaaattttgctaccaacagcttccggtaacattgagactaatatataccattttccaggaaatggctaagtttgaagagccagacattctttttaatatgctcaattgcctgaagattctctgtctgcatggagaatgtttatacattgccagaaaagatcaccctcaatttttagcctacattcaggaccacatgttgattgcaagcctgtggagggtcgtcaaatccgagttctctcagctgtcttccctggcagtccctcttctcctccatgccctgtcacttcctcatggtgctgacatcttctggacaatcataaatggcaatttcaacagcaaagactggaagatgaggtttgaagcagtggaaaaagttgctgtaatttgtagatttctggatattcactcagtaaccaaaaaccacctgctgaagtactccctggcacatgccttctgctgcttcctgacagcagtggaggatgtcaaccccgcagtggctaccagagctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcgacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaaggtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccgtccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacgtgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgctggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaagctttcttgctacacatatttctgatgactccttgggctatctgattaagtgtttccttacattattttttaaaaaccaaatcatttttctttaactaacttctattttttttaagaaaaaaaaatagactggtgggtactcacagaaaagttgtataagtccccctgttgctatttttgatgatagagaataaatagggtttttgaaa

SEQ ID NO: 198199 - DNA, 7908 bp, Homo sapiens
  Payload ID: 19101
  Gene Name: unc-79 homolog (C. elegans)
  Uniprot ID: Q9P2D8
  ENST ID: ENST00000393151
  CDS Start-End: 1-7908
atgtccaccaaagcggagcagtttgcttccaagatccggtacttgcaggaatatcataaccgggttctccacaacatttatcctgtaccatcaggaacagatattgcaaacaccttgaaatacttttctcagaccttgttaagcattttgtcccgcacagggaagaaggaaaaccaagatgcctccaatttgacagtgcccatgaccatgtgtctttttcctgtgccattcccactcaccccatctctaagaccgcaggtcagttccatcaaccctactgttactcgctccctcctttacagcgtcctgcgagatgctccctcagaacgcggcccgcaaagtcgtgatgctcagttgtcagactacccttctttggactaccaaggcctctacgtgactttggtgaccctcctggatctagttcctttactacagcacggccaacacgatcttggacagtcgatattttatacaactacatgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagtgtatcattgtcaattactggaatgcctcatgaaatataaacaagaagtctggaaagatcttttgtatgtgattgcgtatgggccttcacaagtgaagcctccagctgtgcaaatgcttttccactactggcccaatttaaaacctcctggggcaataagcgagtacagggggttgcagtacacagcttggaatcccatccactgccagcacattgaatgccacaatgcaattaacaaaccagctgtgaagatgtgtatagacccttccctgtcagtagcgttgggtgataaaccacccccgttgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggcctctcctcttcccaccattccctggataatgctgactttgataacaaggacgatgataaacacgatcagaggctgctcagtcaattcggaatatggttcttagtgagcctctgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtgagtgttgcctctgatcctggccgacgagttcagcacaatatgcttagtccatttcatagtcctttccagagtccgtttcggagtcctttgcgtagtccgtttcgtagccctttcaagaattttggacacccaggaggaaggactattgactttgattgtgaagatgatgaaatgaatctaaattgtttcatcctcatgtttgatcttctcctgaagcagatggagttacaagatgatggaatcacgatgggtttagagcacagcttatcaaaggacattatttctattataaacaatgtcttccaagccccctgggggggatcccacacctgccagaaggacgaaaaagcaatcgagtgcaacttatgtcagtctagtatcctctgctatcagcttgcttgtgaactcctggagagactagctcctaaagaagaaagccggctggtggagcccacagacagcctggaggatagcctcctttcttccagaccagagtttatcataggccctgaaggggaggaggaggagaatcctgcaagcaagcatggggagaacccaggcaactgcaccgagcccgtggaacatgctgcagtaaagaatgataccgaaagaaaattttgctaccaacagcttccggtaacattgagactaatatataccattttccaggaaatggctaagtttgaagagccagacattctttttaatatgctcaattgcctgaagattctctgtctgcatggagaatgtttatacattgccagaaaagatcaccctcaatttttagcctacattcaggaccacatgttgattgcaagcctgtggagggtcgtcaaatccgagttctctcagctgtcttccctggcagtccctcttctcctccatgccctgtcacttcctcatggtgctgacatcttctggacaatcataaatggcaatttcaacagcaaagactggaagatgaggtttgaagcagtggaaaaagttgctgtaatttgtagatttctggatattcactcagtaaccaaaaaccacctgctgaagtactccctggcacatgccttctgctgcttcctgacagcagtggaggatgtcaaccccgcagtggctaccagagctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcgacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaaggtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccgtccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacgtgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgctggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatga

SEQ ID NO: 198200 - DNA, 8484 bp, Homo sapiens
  Payload ID: 19101
  Gene Name: unc-79 homolog (C. elegans)
  ENST ID: ENST00000555664
  CDS Start-End: 694-8484
ggaccgcagcgcacagggaagccatgctgagggttcctcctgcattttcttcctcgcggtcctcaggaacatcctcgcgccctccggccccggcgctccagcccgccccggatccgcctccctctccttcctccccgaggttgagacgaagcgtgggacgcacctgggtccctctctggtcaccctgctgaggctccgggggctgctccgggagcaggatttacaggcccggagaacgccaatgggagatccaaatggtcggggactccggcgctttaagaggcttttctctgggaaacacccgtcccctccgtgcgccttatgaatggaaatactcctcccccggtcgagcccattttcccatttcaccaggagccgcagcctgctctctcctttcggtctccccgcccacatcaacgcgggcagctccaggaggggacggacaggaagcctttggccgcctattaaatcccacccatttctccgggggcgatttcctaaccttccgggaccgaattctgcaatttgatgtgcgttttgtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtttgcttccaagatccggtacttgcaggaatatcataaccgggttctccacaacatttatcctgtaccatcaggaacagatattgcaaacaccttgaaatacttttctcagaccttgttaagcattttgtcccgcacagggaagaaggaaaaccaagatgcctccaatttgacagtgcccatgaccatgtgtctttttcctgtgccattcccactcaccccatctctaagaccgcaggtcagttccatcaaccctactgttactcgctccctcctttacagcgtcctgcgagatgctccctcagaacgcggcccgcaaagtcgtgatgctcagttgtcagactacccttctttggactaccaaggcctctacgtgactttggtgaccctcctggatctagttcctttactacagcacggccaacacgatcttggacagtcgatattttatacaactacatgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagtgtatcattgtcaattactggaatgcctcatgaaatataaacaagaagtctggaaagatcttttgtatgtgattgcgtatgggccttcacaagtgaagcctccagctgtgcaaatgcttttccactactggcccaatttaaaacctcctggggcaataagcgagtacagggggttgcagtacacagcttggaatcccatccactgccagcacattgaatgccacaatgcaattaacaaaccagctgtgaagatgtgtatagacccttccctgtcagtagcgttgggtgataaaccacccccgttgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggcctctcctcttcccaccattccctggataatgctgactttgataacaaggacgatgataaacacgatcagaggctgctcagtcaattcggaatatggttcttagtgagcctctgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtgagtgttgcctctgatcctggccgacgagttcagcacaatatgcttagtccatttcatagtcctttccagagtccgtttcggagtcctttgcgtagtccgtttcgtagccctttcaagaattttggacacccaggaggaaggactattgactttgattgtgaagatgatgaaatgaatctaaattgtttcatcctcatgtttgatcttctcctgaagcagatggagttacaagatgatggaatcacgatgggtttagagcacagcttatcaaaggacattatttctattataaacaatgtcttccaagccccctgggggggatcccacacctgccagaaggacgaaaaagcaatcgagtgcaacttatgtcagtctagtatcctctgctatcagcttgcttgtgaactcctggagagactagctcctaaagaagaaagccggctggtggagcccacagacagcctggaggatagcctcctttcttccagaccagagtttatcataggccctgaaggggaggaggaggagaatcctgcaagcaagcatggggagaacccaggcaactgcaccgagcccgtggaacatgctgcagtaaagaatgataccgaaagaaaattttgctaccaacagcttccggtaacattgagactaatatataccattttccaggaaatggctaagtttgaagagccagacattctttttaatatgctcaattgcctgaagattctctgtctgcatggagaatgtttatacattgccagaaaagatcaccctcaatttttagcctacattcaggaccacatgttgattgcaagcctgtggagggtcgtcaaatccgagttctctcagctgtcttccctggcagtccctcttctcctccatgccctgtcacttcctcatggtgctgacatcttctggacaatcataaatggcaatttcaacagcaaagactggaagatgaggtttgaagcagtggaaaaagttgctgtaatttgtagatttctggatattcactcagtaaccaaaaaccacctgctgaagtactccctggcacatgccttctgctgcttcctgacagcagtggaggatgtcaaccccgcagtggctaccagagctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcgacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaaggtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccgtccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaaaacagatacagcctgggaaacgccagtgtaacgtgccaacgtgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgctggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatga

SEQ ID NO: 198201 - DNA, 9100 bp, Homo sapiens
  Payload ID: 19101
  Gene Name: unc-79 homolog (C. elegans)
  Uniprot ID: Q9P2D8
  ENST ID: ENST00000553484
  CDS Start-End: 155-8128
gtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtttgcttccaagatccggtacttgcaggaatatcataaccgggttctccacaacatttatcctgtaccatcaggaacagatattgcaaacaccttgaaatacttttctcagaccttgttaagcattttgtcccgcacagggaagaaggaaaaccaagatgcctccaatttgacagtgcccatgaccatgtgtctttttcctgtgccattcccactcaccccatctctaagaccgcaggtcagttccatcaaccctactgttactcgctccctcctttacagcgtcctgcgagatgctccctcagaacgcggcccgcaaagtcgtgatgctcagttgtcagactacccttctttggactaccaaggcctctacgtgactttggtgaccctcctggatctagttcctttactacagcacggccaacacgatcttggacagtcgatattttatacaactacatgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagtgtatcattgtcaattactggaatgcctcatgaaatataaacaagaagtctggaaagatcttttgtatgtgattgcgtatgggccttcacaagtgaagcctccagctgtgcaaatgcttttccactactggcccaatttaaaacctcctggggcaataagcgagtacagggggttgcagtacacagcttggaatcccatccactgccagcacattgaatgccacaatgcaattaacaaaccagctgtgaagatgtgtatagacccttccctgtcagtagcgttgggtgataaaccacccccgttgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggcctctcctcttcccaccattccctggataatgctgactttgataacaaggacgatgataaacacgatcagaggctgctcagtcaattcggaatatggttcttagtgagcctctgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtgagtgttgcctctgatcctggccgacgagttcagcacaatatgcttagtccatttcatagtcctttccagagtccgtttcggagtcctttgcgtagtccgtttcgtagccctttcaagaattttggacacccaggaggaaggactattgactttgattgtgaagatgatgaaatgaatctaaattgtttcatcctcatgtttgatcttctcctgaagcagatggagttacaagatgatggaatcacgatgggtttagagcacagcttatcaaaggacattatttctattataaacaatgtcttccaagccccctgggggggatcccacacctgccagaaggacgaaaaagcaatcgagtgcaacttatgtcagtctagtatcctctgctatcagcttgcttgtgaactcctggagagactagctcctaaagaagaaagccggctggtggagcccacagacagcctggaggatagcctcctttcttccagaccagagtttatcataggccctgaaggggaggaggaggagaatcctgcaagcaagcatggggagaacccaggcaactgcaccgagcccgtggaacatgctgcagtaaagaatgataccgaaagaaaattttgctaccaacagcttccggtaacattgagactaatatataccattttccaggaaatggctaagtttgaagagccagacattctttttaatatgctcaattgcctgaagattctctgtctgcatggagaatgtttatacattgccagaaaagatcaccctcaatttttagcctacattcaggaccacatgttgattgcaagcctgtggagggtcgtcaaatccgagttctctcagctgtcttccctggcagtccctcttctcctccatgccctgtcacttcctcatggtgctgacatcttctggacaatcataaatggcaatttcaacagcaaagactggaagatgaggtttgaagcagtggaaaaagttgctgtaatttgtagatttctggatattcactcagtaaccaaaaaccacctgctgaagtactccctggcacatgccttctgctgcttcctgacagcagtggaggatgtcaaccccgcagtggctaccagagctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcctatgaggttgaccaggcatgagcagtctgctccagctctcggtgggacacccgaacagacgccaggacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaaggtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccgtccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacgtgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgctggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaagctttcttgctacacatatttctgatgactccttgggctatctgattaagtgtttccttacattattttttaaaaaccaaatcatttttctttaactaacttctattttttttaagaaaaaaaaatagactggtgggtactcacagaaaagttgtataagtccccctgttgctatttttgatgatagagaataaatagggtttttgaaacctttgtagtgttttttcttaaaatccactcttggcaatgcaataaaaaaaaccgtcaccataagccagtgacacctgactgaagctttttgtctttatcctgggaaaagtggcagcttgcaaggaacattacaaagtgcacttagaaattaggtggttaaactgtgccaattgttttcgttgttttataatatcattttccaaaactgtccagtaagttttattatttttaaaactagtttttcaactcattagttctaggctgtactctcttgtaagctttatgataaccactttagttttgtgaataataaattttattcttttgttaatacttgtatacaatttaattgaaaactgtagcttgcacactggaccagatgagtccctcactggcacagtgccctgcacctggagtgatgtttcataaaacggaattttaatagtgtaagagcaccaagatttctctgcacctatacctagcgttggactgtgcattccaaatgaaattcctcctctttatccctgtaatgcactgactaacagaagacttactacacatttaaactgtatattgacatgctattaaatgcgttttttatta

SEQ ID NO: 198202 - DNA, 7377 bp, Homo sapiens
  Payload ID: 19101
  Gene Name: unc-79 homolog (C. elegans)
  Uniprot ID: Q9P2D8
  ENST ID: ENST00000615108
  CDS Start-End: 1-7377
atgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagtgtatcattgtcaattactggaatgcctcatgaaatataaacaagaagtctggaaagatcttttgtatgtgattgcgtatgggccttcacaagtgaagcctccagctgtgcaaatgcttttccactactggcccaatttaaaacctcctggggcaataagcgagtacagggggttgcagtacacagcttggaatcccatccactgccagcacattgaatgccacaatgcaattaacaaaccagctgtgaagatgtgtatagacccttccctgtcagtagcgttgggtgataaaccacccccgttgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggcctctcctcttcccaccattccctggataatgctgactttgataacaaggacgatgataaacacgatcagaggctgctcagtcaattcggaatatggttcttagtgagcctctgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtgagtgttgcctctgatcctggccgacgagttcagcacaatatgcttagtccatttcatagtcctttccagagtccgtttcggagtcctttgcgtagtccgtttcgtagccctttcaagaattttggacacccaggaggaaggactattgactttgattgtgaagatgatgaaatgaatctaaattgtttcatcctcatgtttgatcttctcctgaagcagatggagttacaagatgatggaatcacgatgggtttagagcacagcttatcaaaggacattatttctattataaacaatgtcttccaagccccctgggggggatcccacacctgccagaaggacgaaaaagcaatcgagtgcaacttatgtcagtctagtatcctctgctatcagcttgcttgtgaactcctggagagactagctcctaaagaagaaagccggctggtggagcccacagacagcctggaggatagcctcctttcttccagaccagagtttatcataggccctgaaggggaggaggaggagaatcctgcaagcaagcatggggagaacccaggcaactgcaccgagcccgtggaacatgctgcagtaaagaatgataccgaaagaaaattttgctaccaacagcttccggtaacattgagactaatatataccattttccaggaaatggctaagtttgaagagccagacattctttttaatatgctcaattgcctgaagattctctgtctgcatggagaatgtttatacattgccagaaaagatcaccctcaatttttagcctacattcaggaccacatgttgattgcaagcctgtggagggtcgtcaaatccgagttctctcagctgtcttccctggcagtccctcttctcctccatgccctgtcacttcctcatggtgctgacatcttctggacaatcataaatggcaatttcaacagcaaagactggaagatgaggtttgaagcagtggaaaaagttgctgtaatttgtagatttctggatattcactcagtaaccaaaaaccacctgctgaagtactccctggcacatgccttctgctgcttcctgacagcagtggaggatgtcaaccccgcagtggctaccagagctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcgacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaaggtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccgtccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacgtgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgctggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatga

SEQ ID NO: 198203 - DNA, 7377 bp, Homo sapiens; identical to SEQ ID NO: 198202
  Payload ID: 19101
  Gene Name: unc-79 homolog (C. elegans)
  Uniprot ID: Q9P2D8
  ENST ID: ENST00000621021
  CDS Start-End: 1-7377

SEQ ID NO: 198204 - DNA, 8400 bp, Homo sapiens; identical to SEQ ID NO: 198198
  Payload ID: 19101
  Gene Name: unc-79 homolog (C. elegans)
  Uniprot ID: Q9P2D8
  ENST ID: ENST00000627695
  CDS Start-End: 656-8032

SEQ ID NO: 198205 - DNA, 9100 bp, Homo sapiens; identical to SEQ ID NO: 198201
  Payload ID: 19101
  Gene Name: unc-79 homolog (C. elegans)
  Uniprot ID: Q9P2D8
  ENST ID: ENST00000629588
  CDS Start-End: 155-8128

SEQ ID NO: 198206 - DNA, 7908 bp, Homo sapiens; identical to SEQ ID NO: 198199
  Payload ID: 19101
  Gene Name: unc-79 homolog (C. elegans)
  Uniprot ID: Q9P2D8
  ENST ID: ENST00000627404
  CDS Start-End: 1-7908

SEQ ID NO: 198207 - DNA, 8484 bp, Homo sapiens; identical to SEQ ID NO: 198200
  Payload ID: 19101
  Gene Name: unc-79 homolog (C. elegans)
  ENST ID: ENST00000629205
  CDS Start-End: 694-8484

SEQ ID NO: 198208 - DNA, 13440 bp, Homo sapiens
  Payload ID: 19102
  Gene Name: unc-80 homolog (C. elegans)
  Uniprot ID: Q8N2C7
  ENST ID: ENST00000272845
  CDS Start-End: 35-9739
gggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggtttgtgaaacattccagtctgattccatctcacccaaggccaccatttcaggctgtcaccgaggaaactcctttgatggaagtctgtcctcccaaacttcccaggaaagaggcccatcacattccagggcctctcttgtgatacctccgtgccaaaggtcccgctatgccacctactttgacgttgctgttctgcgctgcctacttcagccccattggtctgaggaaggcactcagtggtctctgatgtactatctacaaaggctgcgacacatgttggaagagaagccagaaaagcctccggagccagatattcctctcctgcccagacccaggagtagctccatggtggcagcagctccctcactagtgaacacccacaaaacccaagatctcaccatgaagtgtaacgaggaggaaaaatctcttagctctgaggccttttccaaggtttcactgaccaatctgcgtagatctgcagtcccagatctttcttcagacctgggcatgaatatttttaaaaagttcaagagccgcaaagaagaccgagagaggaaaggctccattccattccaccacacaggcaagaggaggccacggagaatgggagtgcccttcctgcttcacgaggaccacctggatgtgtcccccacgcgcagcacattctcctttggaagtttctctgggctgggagaagacaggcgaggaattgagaaaggaggctggcaaaccaccattttagggaaattgacccggcgaggcagttcagatgcagccactgagatggagagtctgagcgccaggcattcccactcccatcacaccctggtaagcgacctgccggacccctccaacagccatggagaaaacaccgtcaaggaagtgcgatctcagatctccaccatcacagttgcgaccttcaataccactttggcgtcattcaacgtaggctatgcagactttttcaatgagcatatgaggaaactctgcaaccaggtgcctatcccggagatgccacatgaacctctggcatgtgctaacctacctcgaagcctcacagactcctgcataaactacagctacctagaggacacagaacatattgacgggaccaataactttgtccacaagaatggaatgcttgatctttctgtagttctgaaggctgtttatcttgtccttaatcatgacatcagctctcgtatctgtgacgtggcgctaaacattgtggaatgcttgcttcaacttggtgtggtgccctgtgtagaaaagaatagaaagaagagtgaaaacaaggaaaatgagaccttggaaaagaggccaagtgagggagctttccaattcaaaggagtatctggaagttccacctgtggattcggaggccctgctgttagtggagctggagatggtggaggagaagaaggaggaggtggagatggaggaggtggaggaggtgatggaggaggaggtggaggaggtggaggcggcccttatgagaagaatgataagaaccaagagaaggatgaaagtacacctgtaagcaaccataggcttgctctaacaatgctcatcaaaatagtgaagtctttgggatgtgcctatggttgtggtgaaggacaccgagggctctctggagatcgtctgagacaccaggcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggtcagaggcgggaagcattgtggataaaggccaggtatcctctgcacctgaggaatgtcgcagcttcatgtctggtcgcccctcacagactccagagcacgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaaggaactggctgaagagatcatccctctcaggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagtagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataaggggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttttccttatagtatcctgtgcctgccctggagggcatattttcagatattaaggttagtgttgttagaatcggtttaataaaataacattttcctaatagaaacaatattcttatgatacttggaacatctaagtttataaggaaaaatgtataaagtaagcaatttcttcatagacacctccagtttatatattttgcaaataggcctttaacttgaagttcaattacttcaagaaaagtgtaacacttagaaggcttgtgaggccaacacctagtgtgttactgatcctatggtagggctgtgcatcacgtggttcacaattgaatttcaaaattttaacagtttacattagaaaactgttacctaacaaccaagcatatacaaactcatatacatacttaaattggtacggtggtgtatgtgtgcgtgcgtgtgtgtgtgtatgtgttgtagtcctcaagatgaagttaaatatagactttaattaccctgcaatgaatttaaaacacattctgtatgcttaaactttgagtgcgttggctgtgaaatgtatacatatataaagaggatacctactaaacccaccttaatcataaaggaaaattattttttgttagaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgtcttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtagaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtcataaatgaatagaagtacagtctgaaacatgaattaaatatccttcctcaagttataaaggatactttaatagaacacagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaataaatctaaaaacattaaa

SEQ ID NO: 198209 - DNA, 2253 bp, Homo sapiens
  Payload ID: 19102
  Gene Name: unc-80 homolog (C. elegans)
  ENST ID: ENST00000333907
  CDS Start-End: 1-1641
attcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagaggtaaacagctatggttatactgtactctgcatttgggggcaaagttagaaattctgaaaatacactcctgttattctacaaagacagaaagagaagcaagcaatggtaatgtttttagatagatcattccacaaaggatttgtcaactaggttcctgcaggcaacactttgcagttttctaagccaagctagtagaagggatcccaatttccaagtattgtctctccttaaaaattttccatagacacatggtcttctttctgttgtcaaatggcattcttgtatttcagatttatcattagctaagctaatgatgggtacttggcaagagtttggaccatctttatgtttttggtaaagtttaggcttctgatatattattagtattcagttgtaggtagtgacacttaaccaagcagaaaaggatctatgccactgagtgtgaccttgggcaggtcatttaaccgtaatccacagttctccctctgtaaaatgaagaggtttgctaaaatgatctttaagataacttctcatctatagttctatgattccatgacaaaacccctttaaatattttgtgtgttctctgtctcttaagaatataagtaaaaaaaaa

SEQ ID NO: 198210 - DNA, 13562 bp, Homo sapiens
  Payload ID: 19102
  Gene Name: unc-80 homolog (C. elegans)
  Uniprot ID: Q8N2C7
  ENST ID: ENST00000439458
  CDS Start-End: 81-9857
agcagcgggaggaggcggcggcggcggctagcgaggagacagagctgggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggtttgtgaaacattccagtctgattccatctcacccaaggccaccatttcaggctgtcaccgaggaaactcctttgatggaagtctgtcctcccaaacttcccaggaaagaggcccatcacattccagggcctctcttgtgatacctccgtgccaaaggtcccgctatgccacctactttgacgttgctgttctgcgctgcctacttcagccccattggtctgaggaaggcactcagtggtctctgatgtactatctacaaaggctgcgacacatgttggaagagaagccagaaaagcctccggagccagatattcctctcctgcccagacccaggagtagctccatggtggcagcagctccctcactagtgaacacccacaaaacccaagatctcaccatgaagtgtaacgaggaggaaaaatctcttagctctgaggccttttccaaggtttcactgaccaatctgcgtagatctgcagtcccagatctttcttcagacctgggcatgaatatttttaaaaagttcaagagccgcaaagaagaccgagagaggaaaggctccattccattccaccacacaggcaagaggaggccacggagaatgggagtgcccttcctgcttcacgaggaccacctggatgtgtcccccacgcgcagcacattctcctttggaagtttctctgggctgggagaagacaggcgaggaattgagaaaggaggctggcaaaccaccattttagggaaattgacccggcgaggcagttcagatgcagccactgagatggagagtctgagcgccaggcattcccactcccatcacaccctggtaagcgacctgccggacccctccaacagccatggagaaaacaccgtcaaggaagtgcgatctcagatctccaccatcacagttgcgaccttcaataccactttggcgtcattcaacgtaggctatgcagactttttcaatgagcatatgaggaaactctgcaaccaggtgcctatcccggagatgccacatgaacctctggcatgtgctaacctacctcgaagcctcacagactcctgcataaactacagctacctagaggacacagaacatattgacgggaccaataactttgtccacaagaatggaatgcttgatctttctgtagttctgaaggctgtttatcttgtccttaatcatgacatcagctctcgtatctgtgacgtggcgctaaacattgtggaatgcttgcttcaacttggtgtggtgccctgtgtagaaaagaatagaaagaagagtgaaaacaaggaaaatgagaccttggaaaagaggccaagtgagggagctttccaattcaaaggagtatctggaagttccacctgtggattcggaggccctgctgttagtggagctggagatggtggaggagaagaaggaggaggtggagatggaggaggtggaggaggtgatggaggaggaggtggaggaggtggaggcggcccttatgagaagaatgataagaaccaagagaaggatgaaagtacacctgtaagcaaccataggcttgctctaacaatgctcatcaaaatagtgaagtctttgggatgtgcctatggttgtggtgaaggacaccgagggctctctggagatcgtctgagacaccaggtattccgagagaatgcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggtcagaggcgggaagcattgtggataaaggccaggtatcctctgcacctgaggaatgtcgcagcttcatgtctggtcgcccctcacagactccagagcacgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaaggaactggctgaagagatcatccctctcaggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagtagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagagtgaacctaatgtcctcgatgactcccagggcctggccgccgagggcagcctctctagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataaggggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttttccttatagtatcctgtgcctgccctggagggcatattttcagatattaaggttagtgttgttagaatcggtttaataaaataacattttcctaatagaaacaatattcttatgatacttggaacatctaagtttataaggaaaaatgtataaagtaagcaatttcttcatagacacctccagtttatatattttgcaaataggcctttaacttgaagttcaattacttcaagaaaagtgtaacacttagaaggcttgtgaggccaacacctagtgtgttactgatcctatggtagggctgtgcatcacgtggttcacaattgaatttcaaaattttaacagtttacattagaaaactgttacctaacaaccaagcatatacaaactcatatacatacttaaattggtacggtggtgtatgtgtgcgtgcgtgtgtgtgtgtatgtgttgtagtcctcaagatgaagttaaatatagactttaattaccctgcaatgaatttaaaacacattctgtatgcttaaactttgagtgcgttggctgtgaaatgtatacatatataaagaggatacctactaaacccaccttaatcataaaggaaaattattttttgttagaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgtcttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtagaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtcataaatgaatagaagtacagtctgaaacatgaattaaatatccttcctcaagttataaaggatactttaatagaacacagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaataaatctaaaaacattaaagatg

SEQ ID NO: 198211 - DNA, 2116 bp, Homo sapiens
  Payload ID: 19103
  Gene Name: unc-93 homolog A (C. elegans)
  Uniprot ID: Q86WB7
  ENST ID: ENST00000230256
  CDS Start-End: 176-1549
attaacgagtgacagtcttaatgactaacacacctctaacatttcacctctagctcagatgagagagagaatgggacttcttggtactgattgtttttcccatgcctcaattggtttcttttagggagctacaaatttacgtgttcactggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatattccagtcatccggtgtgtggggcaacttgatctcatcgctggtatttggccagactcccagccaagagacccttccagaagagcagctcacgtcctgtggggccagtgactgcctgatggccaccacaaccaccaacagcacccagaggccctcccagcagctggtctacaccctcctgggcatctacactgggagtggtgtcctggctgtcctgatgatagctgcgttcctccaacccatacgagatgttcagcgggaaagtgaaggagagaagaaatcagtacctttctggtccactttactgtcgactttcaagctatatagagataaacgtctgtgcctcttaattctgctgccgctgtacagtggattgcagcaaggattcctctccagcgaatacacaaggtcctatgtcacctgcaccctgggcatccagttcgtcggctacgtgatgatctgcttctcggccactgacgcgctgtgctccgtgttgtatggaaaggtctcgcagtacacgggcagggctgtgctgtacgtgctgggcgcggtgacccacgtgtcctgcatgattgccctactgctgtggagacctcgtgctgaccatctggcagtgttcttcgtattctctggcctgtggggcgtggcagatgccgtctggcagacacaaaacaatgctctctacggcgttctgtttgagaagagcaaggaagctgccttcgccaattaccgcctgtgggaggccctgggcttcgtcattgccttcgggtacagcatgtttttgtgcgtgcacgtcaagctctacattctgctgggggtcctgagcctgaccatggtggcgtatgggcttgtggagtgcgtggagtccaagaacccgatcagaccccacgctccaggacaggtcaaccaggcagaggatgaagaaatacaaacaaaaatgtgagagcagtgaggtccgaggaggatgaactcagaaagcaccagccagagaattttcttagaagatgcctcaggacatagagcggctcctcatcaccatctcagcacaatttggccattctgaagagatcatgttatttcactcttcatgtattttttttctattctaacaaatttttcgtccaccatcttaacagagatcaagtgtatacatgaaggtatcagttcatttaattttagatgcaaaagaaaaaggtctaacgtacaatcagccaattagaatttgcctgaaatcatagactcaccctagttttattgctgtagttgtttttaagaattggaagcctgcttaaaaaatgtagttgagccccataattttacaaatgggcgaacttttaaacttctaactctacttggatcaaaacctcatacattttacaaaggggtcctgacaagtcagctgactcaacctcacagagtcagggggtgacaaagccagactggggctcaggattcctgaaacgtgtggggtctgcgtttctaaataaagacggttatttaatggacttac

SEQ ID NO: 198212 - DNA, 1810 bp, Homo sapiens
  Payload ID: 19103
  Gene Name: unc-93 homolog A (C. elegans)
  Uniprot ID: Q86WB7
  ENST ID: ENST00000366829
  CDS Start-End: 27-1274
ggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatattccagtcatccggtgtgtggggcaacttgatctcatcgctggtatttggccagactcccagccaagggagtggtgtcctggctgtcctgatgatagctgcgttcctccaacccatacgagatgttcagcgggaaagtgaaggagagaagaaatcagtacctttctggtccactttactgtcgactttcaagctatatagagataaacgtctgtgcctcttaattctgctgccgctgtacagtggattgcagcaaggattcctctccagcgaatacacaaggtcctatgtcacctgcaccctgggcatccagttcgtcggctacgtgatgatctgcttctcggccactgacgcgctgtgctccgtgttgtatggaaaggtctcgcagtacacgggcagggctgtgctgtacgtgctgggcgcggtgacccacgtgtcctgcatgattgccctactgctgtggagacctcgtgctgaccatctggcagtgttcttcgtattctctggcctgtggggcgtggcagatgccgtctggcagacacaaaacaatgctctctacggcgttctgtttgagaagagcaaggaagctgccttcgccaattaccgcctgtgggaggccctgggcttcgtcattgccttcgggtacagcatgtttttgtgcgtgcacgtcaagctctacattctgctgggggtcctgagcctgaccatggtggcgtatgggcttgtggagtgcgtggagtccaagaacccgatcagaccccacgctccaggacaggtcaaccaggcagaggatgaagaaatacaaacaaaaatgtgagagcagtgaggtccgaggaggatgaactcagaaagcaccagccagagaattttcttagaagatgcctcaggacatagagcggctcctcatcaccatctcagcacaatttggccattctgaagagatcatgttatttcactcttcatgtattttttttctattctaacaaatttttcgtccaccatcttaacagagatcaagtgtatacatgaaggtatcagttcatttaattttagatgcaaaagaaaaaggtctaacgtacaatcagccaattagaatttgcctgaaatcatagactcaccctagttttattgctgtagttgtttttaagaattggaagcctgcttaaaaaatgtagttgagccccataattttacaaatgggcgaacttttaaacttctaactctacttggatcaaaacctcatacattttacaaaggggtcctgacaagtcagctgactcaacctcacagagtcagggggtgacaaagccagactggggctcaggattcctgaaacgtgtggggtctgcgttt

SEQ ID NO: 198213 - DNA, 775 bp, Homo sapiens
  Payload ID: 19103
  Gene Name: unc-93 homolog A (C. elegans)
  ENST ID: ENST00000503433
  CDS Start-End: 342-775
gagggccagagttaagacagagcttaagacagagaacctcaacaggaggcctgaaggaaagcacctgggagtcattaggcagcaagggagggaattgcaattctgggcggggctcagctgtgcagagtttagcaaggtctccaggtgcttctgctgagggccagagttaagaaagagcgagaacctcatcaggaggactgaaggaaaggagccaggctgcagccctctgcctgcccttccgtgccatcatctccaggattaatgaaagggccattcaggaaacagcacagggagctacaaatttacgtgttcactggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatatt

SEQ ID NO: 198214 - DNA, 2316 bp, Homo sapiens
  Payload ID: 19104
  Gene Name: unc-93 homolog B1 (C. elegans)
  Uniprot ID: Q9H1C4
  ENST ID: ENST00000227471
  CDS Start-End: 81-1874
gtcccggccgccgggaggaagtggccgggcggtcgcagggactccggggcgaccgccgcgagtccgcagtagttcgggccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtc

SEQ ID NO: 198215 - DNA, 836 bp, Homo sapiens
  Payload ID: 19104
  Gene Name: unc-93 homolog B1 (C. elegans)
  ENST ID: ENST00000524455
  CDS Start-End: 4-648
gccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccagctctgggtgcaggacacacaggagtggcacaggtcgggctggggagagccttctctcctttgtggtccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgt

SEQ ID NO: 198216 - DNA, 833 bp, Homo sapiens
  Payload ID: 19104
  Gene Name: unc-93 homolog B1 (C. elegans)
  ENST ID: ENST00000528423
  CDS Start-End: 294-833
ggaaaaccagaagggaagtgaagggactgcattctctgcagggatggtctcttgttctgagagctgagtgggaaggaagccacctgggaggcgcagcaggaagagcattcaaaccagaaggaacccaggggagagaatctggatattttcaaaagtggccccgtggctccagccagctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaac

SEQ ID NO: 198217 - DNA, 538 bp, Homo sapiens
  Payload ID: 19105
  Gene Name: uncharacterized LOC150527 [Source:EntrezGene
  Acc:150527]
  ENST ID: ENST00000409793
  CDS Start-End: 229-528
cgtcggggacgcccaggccaccggcctgatgagggaagcaggggcagagcgctcaggccagggccggcgggggcactgcgcactggccgcctccctcctctggccaatcctcctgccgctgcgcgtctagtccacctcgtccctctctgcaggtccactaacccatctgattaccggatcctgcttgggtatgaccagcaaagccatcccacagagcacagcaagcagatgacagtgaataagatcatggtgcacgctgactataacgagttgcaccgcatggggagtgacatcaccctgctgcagctgcaccgtcatgtggaattcagctcccacatcctccccgcctgccttccggaaccaaccacgtggctggcccctgacagctcctgctggatatctggttggggaatggtcaccgaggatgcaggcatgttcctacgtgaagcatggagttacgcaatggcctgcctgtccatgaagttcctctggcctcctccgattctgtggctgcaaatccacacctaggagctccgca

SEQ ID NO: 198218 - DNA, 1039 bp, Homo sapiens
  Payload ID: 19105
  Gene Name: uncharacterized LOC150527 [Source:EntrezGene
  Acc:150527]
  ENST ID: ENST00000409982
  CDS Start-End: 172-654
ccagggccggcgggggcactgcgcactggccgcctccctcctctggccaatcctcctgccgctgcgcgtctagtccacctcgtccctctctgcaggtccactaacccatctgattaccggatcctgcttgggtatgaccagcaaagccatcccacagagcacagcaagcagatgacagtgaataagatcatggtgcacgctgactataacgagttgcaccgcatggggagtgacatcaccctgctgcagctgcaccgtcatgtggaattcagctcccacatcctccccgcctgccttccggaaccaaccacgtggctggcccctgacagctcctgctggatatctggttggggaatggtcaccgaggatgtcttcctgcctgagcccttccaacttcaggaggcagaggtcggtgtcatggacaacactgtctgcggatcctttttccagccccagtaccccggccagccaagcagcagtgactacaccatccacgaggacatgctgtgcgctggggacctcataacaggaaaggccatttgccgagtgagtgggctcactctctctcccctgtgctgccctgggcctctgccacagggtctcctctggaccctgccccagccccgacttcttcctgagcccagccaagcctgaggtgtcggagccaggacagaaactcccaacaagcactggcccatctgttttttttgtatcttttaagaaacgttgttggtagggtacagtggctcacgtctgtaatcccagcgctttgggaggtcgaggcgggtggatcacctgaggtcaggagtttgagaccagcctgaccaacatggtgaaaccccatctctactaaaaatacaaaaatcagccgggcatggtggcacgtgcctataatcccagctacttgggaggctgaggcaggagaatcgcttgaacccgggaggcggcagttgcagtgagctgagatcatgccaccgcactccagcctgggtgacagagtgagactccgtctcaaaaaaaaaaaaaaaaaaagaaaaaa

SEQ ID NO: 198219 - DNA, 543 bp, Homo sapiens
  Payload ID: 19105
  Gene Name: uncharacterized LOC150527 [Source:EntrezGene
  Acc:150527]
  ENST ID: ENST00000440359
  CDS Start-End: 23-448
tcccacagagcacagcaagcagatgacagtgaataagatcatggtgcacgctgactataacgagttgcaccgcatggggagtgacatcaccctgctgcagctgcaccgtcatgtggaattcagctcccacatcctccccgcctgccttccggaaccaaccacgtggctggcccctgacagctcctgctggatatctggttggggaatggtcaccgaggatgtcttcctgcctgagcccttccaacttcaggaggcagaggtcggtgtcatggacaacactgtctgcggatcctttttccagccccagtaccccggccagccaagcagcagtgactacaccatccacgaggacatgctgtgcgctggggacctcataacaggaaaggccatttgccgagcatgttcctacgtgaagcatggagttacgcaatggcctgcctgtccatgaagttcctctggcctcctccgattctgtggctgcaaatccacacctaggagctccgcaggcctgctggagcacagcgcctgtaggtttctgcgcct

SEQ ID NO: 198220 - DNA, 1653 bp, Homo sapiens
  Payload ID: 19105
  Gene Name: uncharacterized LOC150527 [Source:EntrezGene
  Acc:150527]
  ENST ID: ENST00000623376
  CDS Start-End: 197-646
gggaagcaggggcagagcgctcaggccagggccggcgggggcactgcgcactggccgcctccctcctctggccaatcctcctgccgctgcgcgtctagtccacctcgtccctctctgcaggtccactaacccatctgattaccggatcctgcttgggtatgaccagcaaagccatcccacagagcacagcaagcagatgacagtgaataagatcatggtgcacgctgactataacgagttgcaccgcatggggagtgacatcaccctgctgcagctgcaccgtcatgtggaattcagctcccacatcctccccgcctgccttccggaaccaaccacgtggctggcccctgacagctcctgctggatatctggttggggaatggtcaccgaggatgtcttcctgcctgagcccttccaacttcaggaggcagaggtcggtgtcatggacaacactgtctgcggatcctttttccagccccagtaccccggccagccaagcagcagtgactacaccatccacgaggacatgctgtgcgctggggacctcataacaggaaaggccatttgccgatgcggggaactgaggcccagagaggaagtgtatcacccaagcgagactccaggggtcccctcgtctgcccattaaatggcacctggttcctgatggggctgtctagttggagcctcgactgctgctcacccgtcggtcccagggtcttcaccaggctcccctacttcaccaactggatcagccagaagaagagggagagcacccctccagatcccgccttggctcctcctcaggaaacacccccagccctggacagcatgacctctcagggcatcgtccacaagcccgggctctgcgcagcccttctggctgctcacatgttcctcctgctgctgattctcctggggagcctgtgaagggccagggcccctggcctcttaccacaagcatgcccacctcaggccggcctccttgctgagctctgcacactcctgacgtgtttccatctctgagctctcctgtccacccaaggccacccctgcctcaggcctgacaaactaaaaaccacccaagaagcttctggctctggtttctggcccaccagagccatctcccatgctccactgtgtctccagctcctcagggagggaaggtctccctcctccctgggcagggtccaggctgaccatatgggagccaagtcactctccttgggaagttgggtcgcgcagactcaggccccattcgggtcctccagggcatgcagtcttccagaaaaatggggccagggcctccccacatggaagaagctgcctgtcctcctggagctgggtgttgtgcaccggtcagggatgaagcggcatcttccaggtgcgcaggtcacagaggctctcctcgacagcttgcaagtaaactgtgaagggggctgaggtcttcggtcagcagtaccagagctgtgtcccatgggtcagctctcagctgactgccccctgtacccgctgccctgccctctccctgcctccagaaacccagcccccatccctgtggcttgctccagcttgtaggggttgtggcttagctgacccaggacttgctggtccagcactgagcccataaaccagactctgagttgcccctgtaaa

SEQ ID NO: 198221 - DNA, 348 bp, Homo sapiens
  Payload ID: 19106
  Gene Name: Uncharacterized protein C12orf79  [Source:UniProtKB/Swiss-Prot
  Acc:G3V211]
  Uniprot ID: G3V211
  ENST ID: ENST00000611108
  CDS Start-End: 1-348
atgaatgtctgctgttcaagccacccagtcaatgaaaaagtttggaaaccttcatctagaaagtggtctagcaaagtgtggtccatggatgagtttgatctgcaaactgcttgttattggttcatgacaaggtgtcagaaggaggctggcaaatttggcactcacagagggaaacctatgtgcttcgtgaggtcattgcttagagtacaactgctaccaagaacattccctgcaaactcttttgtgatcagtttcttcccttctctcatataccctctgcaggtctaccaattgcattttgagagctcagataagcagagagcaatgcaatttgtcacagaaggatga

SEQ ID NO: 198222 - DNA, 532 bp, Homo sapiens
  Payload ID: 19107
  Gene Name: Uncharacterized protein FLJ43738  [Source:UniProtKB/Swiss-Prot
  Acc:Q6ZUG5]
  ENST ID: ENST00000511204
  CDS Start-End: 145-532
gattgccttttgactttaaaaacagaagttccgatcatgaccgaggagcaaaagcaggatttaaatcccctgaccataaagatcaagtgtgcttcctgccttccatcacagcctgtacccattcaggaactagagaggctgtgcatgcctgtgtactgcaagtaccagttccataagactccagttcacaagaccaagggggagccccatggaacccacgtttatttccaggacatcaacgtcatcttccttggggcactgcaccccagtgacctaagggaatacctggagggcccccccatggtggtggaagttcacgaccgggaccgcaagtcagaggagtgttctcagaagcccgtgctgtttggggaggaccctctggattcatacctcaacttccaggccctcatctctcccagagagacagagaacaacccctttgagtcccagaacaagatgtggtacccttatggcatcgcccaggtcagttttgctgacctcctccttggccacaagtacttgaatctggccg

SEQ ID NO: 198223 - DNA, 2291 bp, Homo sapiens
  Payload ID: 19107
  Gene Name: Uncharacterized protein FLJ43738  [Source:UniProtKB/Swiss-Prot
  Acc:Q6ZUG5]
  Uniprot ID: Q6ZUG5
  ENST ID: ENST00000508239
  CDS Start-End: 148-1866
gagcgctttctccatccagctggccgtcatgccgctccttgccgagatggggtttcacaattttggccaggctggtcttgaactcctgacctcgtgattgtcttacatgtccgtgtgaagagaccaaacaggctttgtaggctgtgcatgcctgtgtactgcaagtaccagttccataagactccagttcacaagaccaagggggagccccatggaacccacgtttatttccaggacatcaacgtcatcttccttggggcactgcaccccagtgacctaagggaatacctggagggcccccccatggtggtggaagttcacgaccgggaccgcaagtcagaggagtgttctcagaagcccgtgctgtttggggaggaccctctggattcatacctcaacttccaggccctcatctctcccagagagacagagaacaacccctttgagtcccagaacaagatgtggtacccttatggcatcgcccaggtcagttttgctgacctcctccttggccacaagtacttgaatctggccgtccccatccacagctgtgaggttcagcccacacactgcggccaggacagcaggagaaggaaggttgtggggcttggggtccccagagatggccaccagcacggcccaatgcccaggggcaactacctagaggctgactcccagctcaagttgcgagtggacatcgcggtgccactgagggccggggccagagctgctgatcctgaccttgggggctcccagtttggccgcatcatcttcgtctttgactttaagaaggtctccctgctccacagcctgctgcaggacatcaccatgatcaacgctaaggccctcggcctggactcctaccctgtcaggaccctgcagcagatcctgtcagccttcaaggtgcgtgtgcgggtccaggagcagcagcacctggatgtgctcactggcttccacctgctggacgggaagacacaccttttcatcctggaaggcctggccgaccaaggcttgaggcagctgtgggagaaccaccaaagctggattcccaggtcagaacacaggaaatacaaggtgctgtacaactcacagctgctgttccgcagccggctctatggggacctggaggccatcctgtaccacgtgcacctcttccagcccacggagctgctgctgcagcaggcggtgttcttcctgcgagacactgagcggaggcgggtcttccaggctctagccaggatccacgacatctgctataacagcaccaccctctgggacgtgacggtgagggacctgctgccctcctctgctatgataaaagacttgagccaagagtttgggatgcccctttcgcaagaagaactcacagatgagaaactgtttgccctaccacctcagcctgcccccaatcttgaggactaccacagtcggaactccaccctcaccttagagatccacgcccaccaggagccaagaaagagattcacgtactcacaggattacctctcagccatggtggagcccctggacttgaaggaagaggagaagaaagcccagaagaaatcccgccaggcctggctcacagccaggggattccaagtgacaggtcttcagagcgacaccgaaagcagctttcaggatctcaagctgccacccatcaaagagctgaatgaggagtggaaggaaaactccctgtttgctaatgtactggagcctgtgttggatcgagacaggtggagctgggacaggcaccacgtggactttgatctgtacaagaaaccaccacctttcctcgagctgctcccttcgcccgcaccaaagcctgtaacagtcaggaagaagaaagggaacagccccatctcctgagcagcacagaccctcccacggccaccgcatggtgaacctgcacagcctcccccacacccgaccacaccctcctcaacaatcaacttcattaaagtgcagcaggacagatggcagcagccaggccctgtgtgaggctgggctgggctcacctcgtggtcgtggttgcggagcccaatgcggatggagcggctggcccgcgacagcacggccgtcatgccatacaggttgatgaggatgttggccacccgcttcagtaccagctgctcctccatgatggtctgggatcacagaggctccaagtggggactcactacctagaccagtcccccacatggtccctccctgggctgcatctttgcctgtcttagtctcctgtgttccttgagaaagtggagtcaataacacctttctcttcaggttgtggg

SEQ ID NO: 198224 - DNA, 1989 bp, Homo sapiens
  Payload ID: 19108
  Gene Name: uncharacterized protein LOC100288966  [Source:RefSeq peptide
  Acc:NP_001244291]
  ENST ID: ENST00000616157
  CDS Start-End: 373-1518
agtcgctttgcctggtgtttcttgcttggattggcgttttctccctcgcattcctttgctgggcctgactttttctctgctgggtttggcattcccttgactgggctgggtgtttccttcggaggggggggcttggcctttcctggggtgggcctggggtccccctggtgggcgtgggctttccccgggtgggtgtgggttttccctgggtggggtgggctgggctcccttgctggggttggcaagttttggctgggattgacctttctcttcaaacagattggaaacccaaggtttcctgctagttggtgaaactggttggtagacgcgatctgttcgctactaccggcctcccctggctgttaaaagcagatggtggctgaggtttgttcaatgcccactgcctctactgtgaagaagccatttgatctcaggagcaagatgggcaagtggtgccaccaccgcttcccctgctgcagggggagcggcaagagcaacatgggcacttctggagaccacgacgactcctttatgaagatgctcaggagcaagatgggcaagtgttgccgccactgcttcccctgctgcagggggagcggcacgagcaacgtgggcacttctggagaccatgaaaactcctttatgaagatgctcaggagcaagatgggcaagtggtgctgtcactgcttcccctgctgcagggggagcagcaagagcaacgtgggcgcttggggagactacgaccacagcgccttcatggagccgaggtaccacgtccgtcgagaagatctggacaagctccacagagctgcctggtggggtaaagtccccagaaaggatctcatcgtcatgctcagggacactgacatgaacaagagggacaaggaaaagaggactgctctacatttggcctctgccaatggaaattcagaagtagtacaactcctgctggacagacgatgtcaacttaatgtccttgacaacaaaaaaaggacagctctgataaaggccatacaatgccaggaagatgaatgtgtgttaatgttgctggaacatggcgctgatcgaaatattccagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgtacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccaggtaaagaagcagaagaataatgtttggcagaaggaacacgcaacaagattgtgtgtttgccagaagaacatctaatgagattgcctgtttggcaggaagagcagcaagtgcaaaacacaagatgctgagtgaactttgcagggtttctgagcagttcacttttgctagtaccaaaagtgtgagacaccagaggttgggaataaggtgaatacttagctaagtgtgaaagccaccatgattatatgtaagcaaacaggcatgactgagctcctataaaactttatttacaaagccaaaaggcagattggatttggcctgtggcctatagtttgctgggattgatggaagataaccatgtaaagaaaccaggagaaaaaggaagcttttgcagtagtcagctatagtttccatgtcacacatccttggactagtatcaatgtattctaaggttttcacctgcccatggcaaaataaagtttggaatctcagtt

SEQ ID NO: 198225 - DNA, 2142 bp, Homo sapiens
  Payload ID: 19108
  Gene Name: uncharacterized protein LOC100288966  [Source:RefSeq peptide
  Acc:NP_001244291]
  ENST ID: ENST00000616049
  CDS Start-End: 369-2123
gctttgcctggtgtttcttgcttggattggcgttttctccctcgcattcctttgctgggcctgactttttctctgctgggtttggcattcccttgactgggctgggtgtttccttcggaggggggggcttggcctttcctggggtgggcctggggtccccctggtgggcgtgggctttccccgggtgggtgtgggttttccctgggtggggtgggctgggctcccttgctggggttggcaagttttggctgggattgacctttctcttcaaacagattggaaacccaaggtttcctgctagttggtgaaactggttggtagacgcgatctgttcgctactaccggcctcccctggctgttaaaagcagatggtggctgaggtttgttcaatgcccactgcctctactgtgaagaagccatttgatctcaggagcaagatgggcaagtggtgccaccaccgcttcccctgctgcagggggagcggcaagagcaacatgggcacttctggagaccacgacgactcctttatgaagatgctcaggagcaagatgggcaagtgttgccgccactgcttcccctgctgcagggggagcggcacgagcaacgtgggcacttctggagaccatgaaaactcctttatgaagatgctcaggagcaagatgggcaagtggtgctgtcactgcttcccctgctgcagggggagcagcaagagcaacgtgggcgcttggggagactacgaccacagcgccttcatggagccgaggtaccacgtccgtcgagaagatctggacaagctccacagagctgcctggtggggtaaagtccccagaaaggatctcatcgtcatgctcagggacactgacatgaacaagagggacaaggaaaagaggactgctctacatttggcctctgccaatggaaattcagaagtagtacaactcctgctggacagacgatgtcaacttaatgtccttgacaacaaaaaaaggacagctctgataaaggccatacaatgccaggaagatgaatgtgtgttaatgttgctggaacatggcgctgatcgaaatattccagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgtacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctgacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaggagcagaaaacctgaaaatcagcaatttcctgacactgagaatgaagagtatcacagtgacgaacaaaatgatacccggaaacaactttctgaagaacagaacactggaatatcacaagatgagattctgactaataaacaaaagcagatagaagtggctgaacagaaaatgaattctgagctttctcttagtcataagaaagaagaagatctcttgcgtgaaaacagcgtgttgcaggaagaaattgccgtgctaagactggaactagatgaaacaaaacatcagaaccagctaagggaaaataaaattttggaggaaattgaaagtgtgaaagaaaagactgataaacttctaagggctatgcaattgaatgaagaagcattaacgaaaaccaatatttaagtacagtggacagcttagg

SEQ ID NO: 198226 - DNA, 1424 bp, Homo sapiens
  Payload ID: 19109
  Gene Name: Uncharacterized protein LOC113230  [Source:UniProtKB/Swiss-Prot
  Acc:Q96FF7]
  ENST ID: ENST00000269720
  CDS Start-End: 1-1086
atggccccccagagagcggggccgggtctagggaagccctcttccaagaagtcccgtgccctgagaggagggccaggagtccccagggccagacagcgaagccccagagctgctgcggagctgaacaccgaggtccccaagccctccgcaaaggacgtggagatcctggagcaagagagcgaagtcctcgagccatcagtcgagcaggacgcagagagccccgggctgtccacagctgcgggctttgagagtcctgagccaggcagagacgaccctgggccgtccgaagcgcaaagggcggaggtccaggggcagcatccccctccaggccctaagacctcctcctccaggtcaggctcggaagccccccacctgcgttttccgccgtgccccgaggctccccagcgtcccccggaggagcggttcatggagacgcccatcgagcgcgaaatccgccgcagctgcgaacgcgaggagagcctgcgccggagccggggcctgagcccgggccgcgcaggccgtgaactcgtcgagctgcgcgtgcggccggtgctcaacctgccgggtcctggccccgcgctcccgcgcgccctggagcgggcgcgggcgggcgcgcagatgcagcgggacatcgagcgggaggcccaccggcaggcggcgctggcgcgccccgcggtccccgagccgcgcgcccggtcgccgccgcagccgctgggcgaactcaagcgcttcttcgaggccgcggcggggagcggctcctcggcgggggcgggggacggcgcgggcccgcagaggctgccagagcctgggggacggccgcgctcggccgtgcagggcgggtgccgggtgctgggcagcgccccgccgcctttcactccgtcactgctggagcaggaggtgcgcgccgtgcgcgagcgcgagcaggaactgcagcgccagcggcgcagcgtctatggcaccgcggagttcaaggagcctacgccgagcctcaccgcgagcaggggcgacggaaagttggtggtgatctggcccccccgcagaaaggtctcggagaacggcctggagcaggaggagcgcaaaccttgaggtttgaaaaggctgggacccccggccggaagtaacgtacgcgtcagaggaacagggcggggggcgtctagcattaggcctggagaagggtcggctctctgcattggggaagatgaaatcgacttgcctttgtgaaattgaccagccccctctataaaacttacagtcccccattgggaaactgaccaccacccacaactccgccagtgaaactgcccagcccttctctgcctaattgcaaactgaactaccctctcccttgactgttaagagggccggagttaccgcctcgattgccccactccccccacccccaataaagcctcttctttcagggc

SEQ ID NO: 198227 - DNA, 1535 bp, Homo sapiens
  Payload ID: 19109
  Gene Name: Uncharacterized protein LOC113230  [Source:UniProtKB/Swiss-Prot
  Acc:Q96FF7]
  Uniprot ID: Q96FF7
  ENST ID: ENST00000587086
  CDS Start-End: 537-1196
gggcgacgccttggaacccacggccgccactgccgccacaggtgcctcacagtgccctctgtcctcgctctgggaatcaaaaccccggttgggaactgaggcttccgaactgcttccaaccctggacacgaaggcccccaccggccggagaacgaaaccctggggtcgtctgaagaggagggccaggagtccccagggccagacagcgaagccccagagctgctgcggagctgaacaccgaggtccccaagccctccgcaaaggacgtggagatcctggagcaagagagcgaagtcctcgagccatcagtcgagcaggacgcagagagccccgggctgtccacagctgcgggctttgagagtcctgagccaggcagagacgaccctgggccgtccgaagcgcaaagggcggaggtccaggggcagcatccccctccaggccctaagacctcctcctccaggtcaggctcggaagccccccacctgcgttttccgccgtgccccgaggctccccagcgtcccccggaggagcggttcatggagacgcccatcgagcgcgaaatccgccgcagctgcgaacgcgaggagagcctgcgccggagccggggcctgagcccgggccgcgcaggccgtgaactcgtcgagctgcgcgtgcggccggtgctcaacctgccgggtcctggccccgcgctcccgcgcgccctggagcgggcgcgggcgggcgcgcagatgcagcgggacatcgagcgggaggcccaccggcaggcggcgctggcgcgccccgcggtccccgagccgcgcgcccggtcgccgccgcagccgctgggcgaactcaagcgcttcttcgaggccgcggcggggagcggctcctcggcgggggcgggggacggcgcgggcccgcagaggctgccagagcctgggggacggccgcgctcggccgtgcagggcgggtgccgggtgctgggcagcgccccgccgcctttcactccgtcactgctggagcaggaggtgcgcgccgtgcgcgagcgcgagcaggaactgcagcgccagcggcgcagcgtctatggcaccgcggagttcaaggagcctacgccgagcctcaccgcgagcaggggcgacggaaagttggtggtgatctggcccccccgcagaaaggtctcggagaacggcctggagcaggaggagcgcaaaccttgaggtttgaaaaggctgggacccccggccggaagtaacgtacgcgtcagaggaacagggcggggggcgtctagcattaggcctggagaagggtcggctctctgcattggggaagatgaaatcgacttgcctttgtgaaattgaccagccccctctataaaacttacagtcccccattgggaaactgaccaccacccacaactccgccagtgaaactgcccagcccttctctgcctaattgcaaactgaactaccctctcccttgactgttaagagggccggagttaccgcctcgattgccccactccccccacccccaataaagcctcttctttcagggca

SEQ ID NO: 198228 - DNA, 708 bp, Homo sapiens
  Payload ID: 19109
  Gene Name: Uncharacterized protein LOC113230  [Source:UniProtKB/Swiss-Prot
  Acc:Q96FF7]
  ENST ID: ENST00000590772
  CDS Start-End: 1-453
gccgccgcagccgctgggcgaactcaagcgcttcttcgaggccgcggcggggagcggctcctcggcgggggcgggggacggcgcgggcccgcagaggctgccagagcctgggggacggccgcgctcggccgtgcagggcgggtgccgggtgctgggcagcgccccgccgcctttcactccgtcactgctggagcaggaggtgcgcgccgtgcgcgagcgcgagcaggaactgcagcgccagcggcgcagcgtctatggcaccgcggagttcaaggagcctacgccgagcctcaccggggtgcggccggcctttcatcctggctgccgccagctggtgagctgagcgccccttcccccgcagcgagcaggggcgacggaaagttggtggtgatctggcccccccgcagaaaggtctcggagaacggcctggagcaggaggagcgcaaaccttgaggtttgaaaaggctgggacccccggccggaagtaacgtacgcgtcagaggaacagggcggggggcgtctagcattaggcctggagaagggtcggctctctgcattggggaagatgaaatcgacttgcctttgtgaaattgaccagccccctctataaaacttacagtcccccattgggaaactgaccaccacccacaactccgccagtgaaactgcccagcccttctctgcctaattgcaaactgaactaccctc

SEQ ID NO: 198229 - DNA, 2195 bp, Homo sapiens
  Payload ID: 19110
  Gene Name: uncharacterized protein LOC389831  [Source:RefSeq peptide
  Acc:NP_001229409]
  ENST ID: ENST00000612465
  CDS Start-End: 48-410
taaatttatgtaatttgacaattaatctacctcatgtgcttgcagatatgtattcatttcctaccaccgtagtggaagagatactatccctatctttacaactgatagcatttccaacagtaagctgtgagattctgcttgaaatcacctctcaaacaaataaaaaacagacctgggagacatgctacgctcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggttttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatattagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggttttttacatttaaattatggagcacttcatcatataaaaaacttcaattatatttaaacagtaagtctttggatttttttgccttttaatttccatattacataataatgagataaacattaatgttttcagggtactttaaattttagataattactcattgtattcatgtgaaatttgtttttactgcatgtgtgggttggaggacggttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttc

SEQ ID NO: 198230 - DNA, 1380 bp, Homo sapiens
  Payload ID: 19111
  Gene Name: Uncharacterized protein UNQ6126/PRO20091  [Source:UniProtKB/Swiss-Prot
  Acc:Q6UXV3]
  Uniprot ID: Q6UXV3
  ENST ID: ENST00000623531
  CDS Start-End: 624-1097
ccgtccctgctcgtcttttcatattgctcatggctgcttatattctagctgccaatccacccgcggcgccaagttcaccaaatcacttcacattgcagagcaggctgttacaaatccactgttacgggaaggccaccccatcctctctttgcctcgctccccaactggctcccctctcccccatctatcacttctattccctggtccctgcccacctgccgacccccgcagagcagtcccttcatgcacctgcccctcccgactcgccctgccccttgagagcagaacctgacagcacagggcctggctcagggcgagggttccaggggcattcaatgaaggaatgaacagaccagctgaggctgtgaagcccacggtcacaaagccagactgagcccctcaacctaggcactgcacacacctgtgtgtgtttggcttccccactgagcagctggcagattcacacaactcagtcccagagccaaaggggacaaaggtgaaggctcccaggctgggcagctcgggctggcacctgctggtccttcccatgcagcccatccagcagctggggctcccacagagatgcagggcccagggccaggcggccacagactgcccggagcatgcttccagagcaagggccccagccttccacgatgccgctctggtgcctcctcgccgcctgcaccagcctcccaaggcaggcagccaccatgctggaggaagctgcttctcccaacgaggctgtccacgcatcaacatcaggcagtggcgcactcactgatcagacatttacagacctctcagctgccgaggcctcctcagaggaggttcctgacttcatggaggtgccacactctgttcaccataaaattaactgctttttctacttagaaaaacaactctgccaactgccgtccccactgtgtctaagcagcttgcttactttaaaattaaaaacaacggtcccagctcctggcaggtggtggagcttccagcctcacaaggcattcccacttctggtgggcactcctggaagctggcagagcacaatcgatcccgcgtgggcggccccctctcagccaagcccagggtgagggcagtggggctccaaggaggggaagctggcgaggatgggggccggcggggagagggcggcctgcagggcgtttagcagttggacccccagtcccctgggaagccaaactgagaggtttagacttggggggtaaaatggataaatgaagatgttccgggatagcttattttctaattttacaatgccgtgcttattaatcaggaaaagatcccagtaatgccgacatcaggcacttaaactacacccccagccggtcagaatgggcacaggacatggctcag

SEQ ID NO: 198231 - DNA, 1233 bp, Homo sapiens
  Payload ID: 19112
  Gene Name: uncharacterized serine/threonine-protein kinase SgK494 [Source:EntrezGene
  Acc:124923]
  ENST ID: ENST00000301037
  CDS Start-End: 1-1233
atgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagcgacagatcaaccatccctttgtacacagcttgggggacagctggcagggaaaacggcaccttttcattatgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgaggccatctgaaactgacagactttggtctgtcccgccacgtgccccagggagctcaagcctacactatctgtggcactcttcagtacatggccccagaggtcctaagtggaggaccttacaaccatgctgctgattggtggtccctgggtgtcttgcttttctctctggcgactggaaagtttccagtggctgcagagagagatcatgtggccatgttggcaagtgtgacccacagtgactctgagatcccagcttctcttaaccagggcctctcactcctgctccatgagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttga

SEQ ID NO: 198232 - DNA, 581 bp, Homo sapiens
  Payload ID: 19112
  Gene Name: uncharacterized serine/threonine-protein kinase SgK494 [Source:EntrezGene
  Acc:124923]
  ENST ID: ENST00000530121
  CDS Start-End: 23-581
agagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggagcgacagatcaaccatccctttgtacacagcttgggggacagctggcagggaaaacggcaccttttcattatgtgtagctactgcagcacagatc

SEQ ID NO: 198233 - DNA, 921 bp, Homo sapiens
  Payload ID: 19112
  Gene Name: uncharacterized serine/threonine-protein kinase SgK494 [Source:EntrezGene
  Acc:124923]
  ENST ID: ENST00000578956
  CDS Start-End: 1-441
gtatctttgaaatctgtagccccagaggtcctaagtggaggaccttacaaccatgctgctgattggtggtccctgggtgtcttgcttttctctctggcgactggaaagtttccagtggctgcagagagagatcatgtggccatgttggcaagtgtgacccacagtgactctgagatcccagcttctcttaaccagggcctctcactcctgctccatgagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttagaccagagttccaacctggacattctgctactggcagccacagctggccctattccttccctatcatacaacctacctctcaattcaacatgtcagatcagggtggtgaccttttccttttctttacttctccagtgctctttaccctcaggctgtcagccagagctgcttctgcttgtttctctgccatgtttcctttcttgagcaataataatacttcatgggctcccagggtgctattgatgtgtttaataggcttgtcagaagcaatatgaattttttttttttttttgagacagagtctcactctgttgcccaggctggagtgcagtggtgcgttctcagct

SEQ ID NO: 198234 - DNA, 559 bp, Homo sapiens
  Payload ID: 19112
  Gene Name: uncharacterized serine/threonine-protein kinase SgK494 [Source:EntrezGene
  Acc:124923]
  ENST ID: ENST00000525510
  CDS Start-End: 40-559
gacagcagatttagcagagagaggaggcagaggctgggaatgggagcagtaagctgtcggcaggggcagcacacccagcagggggaacacacccgggtggctgtccctcacaagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccaggtatgcacagagtcctggaaaggattgtgggaagagctaggccaca

SEQ ID NO: 198235 - DNA, 829 bp, Homo sapiens
  Payload ID: 19112
  Gene Name: uncharacterized serine/threonine-protein kinase SgK494 [Source:EntrezGene
  Acc:124923]
  ENST ID: ENST00000494272
  CDS Start-End: 1-278
tgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgaggccatctgaaactgacagactttggtctgtcccgccacgtgccccagggagctcaagcctacactatctgtggcactcttcagtacatgggtgagagaggttaaagctgatgggtaagcattgggcaggaggatagctaaaggatgtctgtgatgagtatctttgaaatctgtagccccagaggtcctaagtggaggaccttacaaccatgctgctgattggtggtccctgggtgtcttgcttttctctctggcgactggaaagtttccagtggctgcagagagagatcatgtggccatgttggcaagtgtgacccacagtgactctgagatcccagcttctcttaaccagggcctctcactcctgctccatgagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgccta

SEQ ID NO: 198236 - DNA, 843 bp, Homo sapiens
  Payload ID: 19113
  Gene Name: unconventional SNARE in the ER 1 homolog (S. cerevisiae)
  Uniprot ID: Q9NZ43
  ENST ID: ENST00000263897
  CDS Start-End: 48-827
ctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagttggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 198237 - DNA, 795 bp, Homo sapiens
  Payload ID: 19113
  Gene Name: unconventional SNARE in the ER 1 homolog (S. cerevisiae)
  ENST ID: ENST00000445667
  CDS Start-End: 9-779
gggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggagcctgagatggacgtaaggaagagaactggagtggcagggtcccagccagtgagtgagaagcagttggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 198238 - DNA, 559 bp, Homo sapiens
  Payload ID: 19113
  Gene Name: unconventional SNARE in the ER 1 homolog (S. cerevisiae)
  ENST ID: ENST00000601662
  CDS Start-End: 61-177
gcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcaggtgagtcaccatgaacacaacaggacttgagggccagctgactaggacaagacatgtatccttgctgccccggggcctccatgccgagactccatgccctgactccaacaggagcatcaccaaactacacctggaggaagagccaggacagagga

SEQ ID NO: 198239 - DNA, 587 bp, Homo sapiens
  Payload ID: 19113
  Gene Name: unconventional SNARE in the ER 1 homolog (S. cerevisiae)
  ENST ID: ENST00000593597
  CDS Start-End: 104-587
catttgtcggccccgcccccccgactcccatgatcaggacatgggaaagacccccgggtgacaatccacttttcctccccagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagttggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcac

SEQ ID NO: 198240 - DNA, 826 bp, Homo sapiens
  Payload ID: 19113
  Gene Name: unconventional SNARE in the ER 1 homolog (S. cerevisiae)
  ENST ID: ENST00000600970
  CDS Start-End: 32-433
ggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggtagggctccttccctgatggacgtaaggaagagaactggagtggcagggtcccagccagtgagtgagaagcagttggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 198241 - DNA, 744 bp, Homo sapiens
  Payload ID: 19113
  Gene Name: unconventional SNARE in the ER 1 homolog (S. cerevisiae)
  ENST ID: ENST00000594724
  CDS Start-End: 9-125
gggcgataatggcggcgtcgaggctggagctaaacctggtgcggctgctatcccgctgcgaggcgatggcagcggagaaacgggacccggacgagtggcgcctggagaagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagttggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagaccc

SEQ ID NO: 198242 - DNA, 1776 bp, Homo sapiens
  Payload ID: 19113
  Gene Name: unconventional SNARE in the ER 1 homolog (S. cerevisiae)
  Uniprot ID: Q9NZ43
  ENST ID: ENST00000595101
  CDS Start-End: 19-426
gtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcaggtgagtcaccatgaacacaacaggacttgagggccagctgactaggacaagacatgtatccttgctgccccggggcctccatgccgagactccatgccctgactccaacaggagcatcaccaaactacacctggaggaagagccaggacagaggaaatggccccgagaggaaacaaagctaggcacagtggctcacacctgtaatttcggaggctgaggcaggtggatcacctgaggtcaggagtttgagaccaacctggccaacatgacaaaaccatgtctctactaaaaatacaaaacttagccggatgcagtgccacgtgtctgtagtcccagctactcgggaggctgaggcaggagaattgcttgaacccaggaggtggaggttgcaatgagctgagatcacaccactgcactccagccggggcgacagagcaagactccgtctcaaaaaaaaaaaaagcaaaaaaattagccaggcgtggtgacgcacacctgtagtcccagcatacttgggaggctgaggcaggaggattgcttgagcctgggaggtagaggttgcagtgagctgagattgcgccagtgcactccagcctagttgacagagagagactctgtctcaaaaataagcaaataaataaattttttaaagctaggcactcccagcctatgggaccaaggctaggctggagggagggacctggggtctgagggaaccgagacaggagtaaggagaccctcctagaagagggggtattcaagcatggtcagaagccaacggggcagcagacaagatgaggaaacagcattccaagcagtagacccagcacaggcaatgctcaggatgccggaaacgggaaaccaacactcgccttttttgcttggcctgttttgctttcagagcctgagatggacgtaaggaagagaacgtgagtgtctgcggccctggggcagtagtggcaattgggcggtgcggcagggacggggtagcagtggccaaaccctggaccaccgaggcactaccacaaggatctaaaccaaccagaagccacttctgtggatgctcttcccagaagtcaaaggccaggcgcagtggctcacgcctgtaatcccaatactttgggaggctgaggcaggcagatcacctgaggccaggagttcaagaccagtctggccaacatggcaaaaccctgtctctactaaaaatacaaaaaattagccgggcatggtggcatgcgcctgtagtcccagctactcaggaggctgaggcaggagaactgcttgaacctgggaggtggaggttacagtgagccgagatcacgccattgcactccagcctgggtgacagagcgagatgctgtctc

SEQ ID NO: 198243 - DNA, 637 bp, Homo sapiens
  Payload ID: 19113
  Gene Name: unconventional SNARE in the ER 1 homolog (S. cerevisiae)
  Uniprot ID: Q9NZ43
  ENST ID: ENST00000596136
  CDS Start-End: 17-457
gtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaacaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 198244 - DNA, 1462 bp, Homo sapiens
  Payload ID: 19114
  Gene Name: uncoupling protein 1 (mitochondrial, proton carrier)
  Uniprot ID: P25874
  ENST ID: ENST00000262999
  CDS Start-End: 77-1000
agagcaagggaaaggaacttcctccaccttcggggctggagcccttttcctctgcatctccagtctctgagtgaagatggggggcctgacagcctcggacgtacacccgaccctgggggtccagctcttctcagctggaatagcggcgtgcttggcggacgtgatcaccttcccgctggacacggccaaagtccggctccaggtccaaggtgaatgcccgacgtccagtgttattaggtataaaggtgtcctgggaacaatcaccgctgtggtaaaaacagaagggcggatgaaactctacagcgggctgcctgcggggcttcagcggcaaatcagctccgcctctctcaggatcggcctctacgacacggtccaggagttcctcaccgcagggaaagaaacagcacctagtttaggaagcaagattttagctggtctaacgactggaggagtggcagtattcattgggcaacccacagaggtcgtgaaagtcagacttcaagcacagagccatctccacggaatcaaacctcgctacacggggacttataatgcgtacagaataatagcaacaaccgaaggcttgacgggtctttggaaagggactactcccaatctgatgagaagtgtcatcatcaattgtacagagctagtaacatatgatctaatgaaggaggcctttgtgaaaaacaacatattagcagatgacgtcccctgccacttggtgtcggctcttatcgctggattttgcgcaacagctatgtcctccccggtggatgtagtaaaaaccagatttattaattctccaccaggacagtacaaaagtgtgcccaactgtgcaatgaaagtgttcactaacgaaggaccaacggctttcttcaaggggttggtaccttccttcttgcgacttggatcctggaacgtcattatgtttgtgtgctttgaacaactgaaacgagaactgtcaaagtcaaggcagactatggactgtgccacataatcagcttcaagaaaatgatgtaacataccagtgggaatcttgctgactggatcataaaaacaaacaaaacttattcacttattttaacctaaaaagataaaggaattttggcagagaattttggacttttttatataaaaaagaggaaaattaatgcctatttcatataactttttttttttctcagtgtcttaagaaggggaaagcaaaacattcagcatataccctggcaaatgtaatgcagataagctactgcatttgaccatttctggagtgcaattgtgtgaatgaatgtgaagaactttaacatgttttaattacaattccaactggtggaaaagaaactgagtgaaatgcagtttatatttataaatacttaaaaatgaagttattaaaaatattagtttttattaaccacagttgtcagttaatatattcaataaagtattgctaatacctttt

SEQ ID NO: 198245 - DNA, 2113 bp, Homo sapiens
  Payload ID: 19115
  Gene Name: uncoupling protein 2 (mitochondrial, proton carrier)
  Uniprot ID: P55851
  ENST ID: ENST00000310473
  CDS Start-End: 844-1773
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggcgtc

SEQ ID NO: 198246 - DNA, 464 bp, Homo sapiens
  Payload ID: 19115
  Gene Name: uncoupling protein 2 (mitochondrial, proton carrier)
  ENST ID: ENST00000539764
  CDS Start-End: 367-464
gggcagcagctgggtcttattcttctctggccttcacaacatcctgcaacccagctcaaggtcaggaatgtgacagactcatgtcatcatatctctgatgcccagagaagggataccatttgcctgagccttctcagtactgtttaatcagcctgtgagaactttccttgtgaaaggccctgtctgtgcctggggctgataaaacagcaagaacgaactgaggagctgggcagcagtgcaaagcaaatactaccagctttggtgcctattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcc

SEQ ID NO: 198247 - DNA, 389 bp, Homo sapiens
  Payload ID: 19115
  Gene Name: uncoupling protein 2 (mitochondrial, proton carrier)
  ENST ID: ENST00000545212
  CDS Start-End: 1-389
gggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacaggcttctgcaccactgtcatcgcctcccctgtagacgtggtcaagacgagatacatgaactctgccctgggccagtacagtagcgctggccactgtgcccttac

SEQ ID NO: 198248 - DNA, 1004 bp, Homo sapiens
  Payload ID: 19115
  Gene Name: uncoupling protein 2 (mitochondrial, proton carrier)
  ENST ID: ENST00000544615
  CDS Start-End: 1-849
gggcaacatgcttatccctgtagctaccctgtcttggccttgcagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttc

SEQ ID NO: 198249 - DNA, 1413 bp, Homo sapiens
  Payload ID: 19115
  Gene Name: uncoupling protein 2 (mitochondrial, proton carrier)
  ENST ID: ENST00000536983
  CDS Start-End: 367-1044
gctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacaggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcc

SEQ ID NO: 198250 - DNA, 2623 bp, Homo sapiens
  Payload ID: 19116
  Gene Name: uncoupling protein 3 (mitochondrial, proton carrier)
  Uniprot ID: P55916
  ENST ID: ENST00000314032
  CDS Start-End: 554-1492
atatttagcacatagtaggcacaaagaaatgacattattattaagagacctgggagagctgtgcccagcctatcgtgggaggccttgacctttggactcaaaagtggcagcaggtccacccccccatacacccttgtcaccaaggaagcgtccacagcttaaaggagctatattaaagcaccccaagtcaagaggactgaaccagatctggaactcactcacctcccctctcacctcactgccctcaccagccagcctcttgtcaagtgatcaggctgtcaaccaacttctctaggataaggtttcaggtcagcccgtgtgtataagaccagtgccaagccagaagcagcagagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggaactttgcccaacatcatgaggaatgctatcgtcaactgtgctgaggtggtgacctacgacatcctcaaggagaagctgctggactaccacctgctcactgacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaagggatttacaccctcctttttgcgtttgggatcctggaacgtggtgatgttcgtaacctatgagcagctgaaacgggccctgatgaaagtccagatgttacgggaatcaccgttttgaacaagacaagaaggccactggtagctaacgtgtccgaaaccagttaagaatggaagaaaacggtgcatccacgcacacatggacacagacccacacatgtttacagaactgttgtttacttgttgctgattcaagaaacagaagtagaagaggaggagggattctggtcttcactgccatgcctcaagaacacctttgttttgcactgacaagatggaaaataaattatattaatttttgaaacccattaggcatgcctaatatttaggcaagagaaaataaaccaagatagatccatttggacaaaatggaaggttggagacgtgtatccccgtgaaatctggttagataatgaatgataagcaggaaggatggcaagcacgggacaggaggggcccacaatggagtgggagatcagccacggagcctggagggatgccacccagcaacacagagctggcgactgcagctgcaccatcacacatgcatcatcagcctatttgtaatatgtctgccacagagagtcctttgggattctaggaaacccaaggaacaagagaaaaaactagagcctgtgctaaagaagccctgctgggcccatgtgaggctggggctcgtaaatattccctgacgacactgaagaatcaagagggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccaccccccccaccacgtgctcaatcatgagtacctcaaaggattgttgggcttgggggaaaagaggtggattcctgggcaagaacctaaagtagcaggactcggaattctcgggaaattattatgactcaataaaagaattcacaccttaggtgtgggagtaagaaca

SEQ ID NO: 198251 - DNA, 1406 bp, Homo sapiens
  Payload ID: 19116
  Gene Name: uncoupling protein 3 (mitochondrial, proton carrier)
  Uniprot ID: P55916
  ENST ID: ENST00000426995
  CDS Start-End: 204-1031
agagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggaactttgcccaacatcatgaggaatgctatcgtcaactgtgctgaggtggtgacctacgacatcctcaaggagaagctgctggactaccacctgctcactgacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaaggggtgagcctcctcctgcctccagcactccctcccagagaacaggggcttctttcttttcgaatgtggctaccgtgggtcaacctgggatgtagcggtgaagagtacagatgtaaatgccacaaagaagaagtttaaaaaaccatgcaagtaaaagaaaaaaagtgaaccatacctgatggggagggttagggaagcctgactgagaacaaacactccaggaataggtaaaagtactgcctgtctccagaggaagttagcaatcctgagacctcctggacctcctgccatggccattgagcaccacactgaccatggccagtgccttcctcactgtctccacacgctccacgttttcttgcacttactgctccctctgcgt

SEQ ID NO: 198252 - DNA, 551 bp, Homo sapiens
  Payload ID: 19116
  Gene Name: uncoupling protein 3 (mitochondrial, proton carrier)
  ENST ID: ENST00000544614
  CDS Start-End: 263-551
attcaagggataggaacgtgacctgtttttataggccaaattcatgcagcttaagtatggcaccacccaggcttctccctttctaaagcccctcctgggtaaggaagagttcctgggagccaggccagacatcactccatcagccttctctggcctgtctcctgcagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcg

SEQ ID NO: 198253 - DNA, 1157 bp, Homo sapiens
  Payload ID: 19117
  Gene Name: undifferentiated embryonic cell transcription factor 1
  Uniprot ID: Q5T230
  ENST ID: ENST00000304477
  CDS Start-End: 16-1041
cgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacatcctgggcccgctgcgcgaccagctgctgaccttgaaccagcacgtggagcagctgcgcggcgccttcgaccagacagtgtccctggccgtgggcttcattctgggcagcgcggccgccgagcgaggggtcctcagggacccgtgccagtgagtcccggctgcggccagtctcccctctccaggccgaggcccctccgccctgacccctcctgctgccttcccacccccgttcttgggtatgttcaataaaaggattgttttcctaga

SEQ ID NO: 198254 - DNA, 3925 bp, Homo sapiens
  Payload ID: 19118
  Gene Name: unkempt family zinc finger
  Uniprot ID: Q9C0B0
  ENST ID: ENST00000589666
  CDS Start-End: 111-2543
ggggggtcttcacgttctcgtggcgcggcgcaggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacgtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcagggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccaggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcacccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctacctccttgccagggcaagggtggagtgtggaagacgtgggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgca

SEQ ID NO: 198255 - DNA, 984 bp, Homo sapiens
  Payload ID: 19118
  Gene Name: unkempt family zinc finger
  ENST ID: ENST00000587501
  CDS Start-End: 33-146
ggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaattgtgtagaatttgacagcagtatcaagagctgaggagaaggagaagatggaaaggagtctagcaacttaaaaatctcacagcattctctgtgaggtgaccttttttcctgttggtggctcaatttctttaggacataaagaagatactgaggcctgtgacagcctgtgacagtatcatcaagtcgtatctgaacttattgaactgtttcctccccttccttattctttattcacagtttgcttttcatgtgcataagttgactcatttgtttcctgttagcatttgaaacaccatatagccaccataagtcctgacaaaatgacttttaataaggagggggaaggtccatgtcccaccttcctatgaaattttggcctattcacaagtctacccccacataagagaagtagttatgttctgtaaagaagaggttgataaaaacctttagcatggtgttttgtgacttagaagttttaagtagtcgttcttatatctaagcatttattaattttggtaagaacattactatacgtttctgatgtcacttttactgttaagaggtgccaggcatctggtgacctgtcacttcaggatttgtgtgaatcagaccatctaaatataatataaattagagactggtacttgtatttcctgattaaaaacaaagtaacgtctgtttta

SEQ ID NO: 198256 - DNA, 651 bp, Homo sapiens
  Payload ID: 19118
  Gene Name: unkempt family zinc finger
  ENST ID: ENST00000586217
  CDS Start-End: 1-208
gcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcaggtgggctgggtgctgggctgggctgatggcagtaggctggggtccagggcaggggcctggcggctaatgatgggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccg

SEQ ID NO: 198257 - DNA, 633 bp, Homo sapiens
  Payload ID: 19118
  Gene Name: unkempt family zinc finger
  ENST ID: ENST00000592629
  CDS Start-End: 20-145
gaggcaggaagacaagaccatgtcgaagggccccgggcccggcggctccgcagcttcctcggcgcccccggccgctaccgctcaggtgctgcaggcacagcccgagaaaccgcagcactacacggcagaggagagagaccagtgaaggttgggaggaggcggccaaaaggagacagcttcatgcccccaggacataaatagcccggctgctgcaggtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcaggtgggctgggtgctgggctgggctgatggca

SEQ ID NO: 198258 - DNA, 660 bp, Homo sapiens
  Payload ID: 19118
  Gene Name: unkempt family zinc finger
  ENST ID: ENST00000587258
  CDS Start-End: 1-660
gactttcgataacagcacagtgccccacccaggaagcatcaccatcggcggcagcttgctgcagagctctgcacccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttggggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtg

SEQ ID NO: 198259 - DNA, 1312 bp, Homo sapiens
  Payload ID: 19118
  Gene Name: unkempt family zinc finger
  ENST ID: ENST00000586527
  CDS Start-End: 27-146
cggcgaagaggcaggaagacaagaccatgtcgaagggccccgggcccggcggctccgcagcttcctcggcgcccccggccgctaccgctcaggtgctgcaggcacagcccgagaaaccgcagcactacacctatgttagatactaaagaaggcttccccacaacccatatgcatctgctttgactggtggtttctatcatcctacaaagactgtgacttattggtgagggcagctggacaactctgagagcaacttagagaaatccatcttgggcacactctataaaggagctccttctctgcaaatagcaccccagataagtgcacaaaagcaagataccctcgtggacctacacgtcctcccgcttttcaacaccctgatgcctgaagctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaattgtgtagaatttgacagcagtatcaagagctgaggagaaggagaagatggaaaggagtctagcaacttaaaaatctcacagcattctctgtgaggtgaccttttttcctgttggtggctcaatttctttaggacataaagaagatactgaggcctgtgacagcctgtgacagtatcatcaagtcgtatctgaacttattgaactgtttcctccccttccttattctttattcacagtttgcttttcatgtgcataagttgactcatttgtttcctgttagcatttgaaacaccatatagccaccataagtcctgacaaaatgacttttaataaggagggggaaggtccatgtcccaccttcctatgaaattttggcctattcacaagtctacccccacataagagaagtagttatgttctgtaaagaagaggttgataaaaacctttagcatggtgttttgtgacttagaagttttaagtagtcgttcttatatctaagcatttattaattttggtaagaacattactatacgtttctgatgtcacttttactgttaagaggtgccaggcatctggtgacctgtcacttcaggatttgtgtgaatcagaccatctaaatataatataaattagagactggtacttgtatttcctgattaaaaacaaagtaacgtctgttttactattgaagtaagagtactttataatgaatacaaaaatgtatattaaatatccagtagagcatgctaaagtgaa

SEQ ID NO: 198260 - DNA, 4320 bp, Homo sapiens
  Payload ID: 19119
  Gene Name: unkempt family zinc finger-like
  Uniprot ID: Q9H9P5
  ENST ID: ENST00000248104
  CDS Start-End: 596-1285
tttgaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtgagtgccggctccctccatgctggcgttgccgtgaagcctccgtggggctccctcccagatgccgtcctgactgaggggcctcacacggaaccttgtgccctatctgtggtggcaaaccacatgacctgctgctcacaggttcccccacgccgcagaccgagtctcgctctgtcgcccaggttggactgcaatggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaaagctgttttctgattactcagagctgtcctaggcaatggtgctttgtagctccttggagatgtcgctgggcgtcctggcaggggtcaggcagtgaactgggagagtggttgcctccccagcacccgtgaccaccctggtcctgctcgtgtgggagatgctcgggccgtgtgtgcgccagggtccggggtgccgggtgtatgtggcagtcacctgacccgcgctgccagttatcatcggagctcatccatgtggccagtgaggtcacaggagaggacccggccacagcctctcagtggcctggagcacacgggggaagcgaccccccccaggtcccggctctgctgtggtcccctgtcccgtctgcccctggagcgacagtgtggtttcggccgcagcagaaacgtgactgagaacgcatccccgcgatgacctgacccttctgctcagggctgggactgtccctaggagttgagcaggaacaggcatctgtggtttacggcgacctggctctccgcgggccacgtgggtggtgagggcacacgagtgggaagcggcaccgacgtgtttctccccgaccgtggctttgccaaagacttttaatagcattttttaagtgcaaaacgtctaggtaaaaatctttatcatcagtgaccaaattagaatgtatttaatatagtaggtggtttaagaactgttttaacgtaagacaaactgatagcaacattctgttgttttaaaggaagtgggtccgtgacattctgcagctagtccactactccaaggtaactatcgacttggtttcagtgaatctattttgtttttaactacagtgatttattagctcagtatctagaaattacgtatattttgtgctactgtcatcgatgtgtaaactctgtttttatttgtatttatgcacttggttcccatttggagcctctggtcttttctgggataagtggtgtctgccgagacatctcccggttgtcagtggtcaggagcagctgagctctagtctgccagctgctctgctctttctgggaaggaggtggcgcccgcccctcagggtgtctccagggctcagcttccggggtggtagagctggggagccccaggggtggggggacagctgggagatggaggtggcacctgctcccctagatcagtactggctctgaggacaggtgagcagtgggaagaccaaagaatggctggcagcgctgccagggttggaaatgggggcaagatcctggggctgtgtgccctggggcctccctcacctgtcttggtggccatggcctcagggatggctcctaggtggctgaggcacagcagtggctggaaggtgccccgtggaggctgaggtggaggcgcgcccagcagctcccccctgtggccatggcgggcacggggcgtaggagctggctggcggccggctctgcatgttcttgttgcctgtcgtctgtaactctagtgttcgacattcgccgtgatacagtggtgtcacgacgtgtgtaactgtggtcagcagaccttgttccgcgtggacgcctcaagtggattaatttctggaagcctcaatctgtatgtttgagtatttacatgagaatgttatttgaatggaattttcttaacccagaaggtagtatttataatcatttacttgtagcgaactgtttaaagttaacacttgtttaaatttttttacactatagcatttatgcaatggtttacagaattcatggagttatttttatcagtatgggaattaattaaaaccttgaatcttt

SEQ ID NO: 198261 - DNA, 1431 bp, Homo sapiens
  Payload ID: 19119
  Gene Name: unkempt family zinc finger-like
  Uniprot ID: Q9H9P5
  ENST ID: ENST00000301712
  CDS Start-End: 61-894
ggatatccgggggcgggggcgccggcgcggcgcatgcgcgctgcattgttttgactgaaaatgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacagctggcagctgggacgccgggtccttaggctgagtcccagggccaacaacccaagggtcgccctgcccagggtgcacacaggaccttcctccaccgcctgagccccagctgtcccctgggtctggcttgtgggtttggcacctcgcagcctgcttgcctctgaagcccctttctcctccttgctccagcccggccttctggttgtgcctggcctggcttgcctcctgtctgcagtttgcacctgagaggggggtgggggggtgcagaccccacagggtgtctggatgcctgggccatggccttggcctccctgaggccctgtctgtgtccagctcttcctttgagcagagagccaccctcgcctcttttgaatgacctggtgctgcctcgcatgccccggagagcacctgtgcttcctttgggaaggacgccccactccttgttgttatgccacgttcagtctccctctgagcagcttccgagtaaaggacctgaacggctgtagaacaaaccacaaattagtgtctgagattttgtcatcgcccgtcatggaaagaaaataaaaattattttttcaacaggcacttaatgtgtcccataaatacaaatcagttacaataaagcagctagagattcca

SEQ ID NO: 198262 - DNA, 897 bp, Homo sapiens
  Payload ID: 19119
  Gene Name: unkempt family zinc finger-like
  ENST ID: ENST00000382757
  CDS Start-End: 7-357
ctgaaaatgccgtcggtttcgaaagcggcggcagcggcgctgagcgggtcccccccgcagactgagaagccgacccactacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtccacgccctgccccagtgtgaagcacggggatgagtggggggaaccctcacgctgcgatggcggcgacggctgccagtattgccactcccgcacggagcagcagttccatcccgagatctacaaatctacaaaatgcaacgacatgcgccaaaccgggtactgcccgcgcggccccttctgtgcctttgcacacgttgaga

SEQ ID NO: 198263 - DNA, 5116 bp, Homo sapiens
  Payload ID: 19119
  Gene Name: unkempt family zinc finger-like
  ENST ID: ENST00000389221
  CDS Start-End: 30-2081
gcatgcgcgctgcattgttttgactgaaaatgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtccacgccctgccccagtgtgaagcacggggatgagtggggggaaccctcacgctgcgatggcggcgacggctgccagtattgccactcccgcacggagcagcagttccatcccgagatctacaaatctacaaaatgcaacgacatgcgccaaaccgggtactgcccgcgcggccccttctgtgcctttgcacacgttgagaagagcctggggatggtgaatgaatggggctgtcacgacctccacctcacgagtccttcctccacgggcagcggccagccgggaaatgccaagcggagagactcgccggccgagggtggccctaggggcagcgagcaagacagcaagcagaaccacctggccgtgtttgcagcggtccacccgccggcccccagcgtgagctccagcgtggcgtccagcctggcgtccagcgccggctccggcagctcctcccccactgcgctgcccgcgccccccgcccgtgccctcccgctcggccccgccagcagcactgtggaggccgtcctcggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaaagctgttttctgattactcagagctgtcctaggcaatggtgctttgtagctccttggagatgtcgctgggcgtcctggcaggggtcaggcagtgaactgggagagtggttgcctccccagcacccgtgaccaccctggtcctgctcgtgtgggagatgctcgggccgtgtgtgcgccagggtccggggtgccgggtgtatgtggcagtcacctgacccgcgctgccagttatcatcggagctcatccatgtggccagtgaggtcacaggagaggacccggccacagcctctcagtggcctggagcacacgggggaagcgaccccccccaggtcccggctctgctgtggtcccctgtcccgtctgcccctggagcgacagtgtggtttcggccgcagcagaaacgtgactgagaacgcatccccgcgatgacctgacccttctgctcagggctgggactgtccctaggagttgagcaggaacaggcatctgtggtttacggcgacctggctctccgcgggccacgtgggtggtgagggcacacgagtgggaagcggcaccgacgtgtttctccccgaccgtggctttgccaaagacttttaatagcattttttaagtgcaaaacgtctaggtaaaaatctttatcatcagtgaccaaattagaatgtatttaatatagtaggtggtttaagaactgttttaacgtaagacaaactgatagcaacattctgttgttttaaaggaagtgggtccgtgacattctgcagctagtccactactccaaggtaactatcgacttggtttcagtgaatctattttgtttttaactacagtgatttattagctcagtatctagaaattacgtatattttgtgctactgtcatcgatgtgtaaactctgtttttatttgtatttatgcacttggttcccatttggagcctctggtcttttctgggataagtggtgtctgccgagacatctcccggttgtcagtggtcaggagcagctgagctctagtctgccagctgctctgctctttctgggaaggaggtggcgcccgcccctcagggtgtctccagggctcagcttccggggtggtagagctggggagccccaggggtggggggacagctgggagatggaggtggcacctgctcccctagatcagtactggctctgaggacaggtgagcagtgggaagaccaaagaatggctggcagcgctgccagggttggaaatgggggcaagatcctggggctgtgtgccctggggcctccctcacctgtcttggtggccatggcctcagggatggctcctaggtggctgaggcacagcagtggctggaaggtgccccgtggaggctgaggtggaggcgcgcccagcagctcccccctgtggccatggcgggcacggggcgtaggagctggctggcggccggctctgcatgttcttgttgcctgtcgtctgtaactctagtgttcgacattcgccgtgatacagtggtgtcacgacgtgtgtaactgtggtcagcagaccttgttccgcgtggacgcctcaagtggattaatttctggaagcctcaatctgtatgtttgagtatttacatgagaatgttatttgaatggaattttcttaacccagaaggtagtatttataatcatttacttgtagcgaactgtttaaagttaacacttgtttaaatttttttacactatagcatttatgcaatggtttacagaattcatggagttatttttatcagtatgggaattaattaaaaccttgaatcttt

SEQ ID NO: 198264 - DNA, 2180 bp, Homo sapiens
  Payload ID: 19119
  Gene Name: unkempt family zinc finger-like
  Uniprot ID: Q9H9P5
  ENST ID: ENST00000397464
  CDS Start-End: 391-939
tttgaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaa

SEQ ID NO: 198265 - DNA, 669 bp, Homo sapiens
  Payload ID: 19119
  Gene Name: unkempt family zinc finger-like
  ENST ID: ENST00000402641
  CDS Start-End: 327-669
gaatccccggcggcggcgcggggcggccgcggaccgtgagtcagcattggcggcggccccagcgcgtggcagccgtgcgccgccaaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccg

SEQ ID NO: 198266 - DNA, 4281 bp, Homo sapiens
  Payload ID: 19119
  Gene Name: unkempt family zinc finger-like
  ENST ID: ENST00000403703
  CDS Start-End: 353-511
gtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtgagtgccggctccctccatgctggcgttgccgtgaagcctccgtggggctccctcccagatgccgtcctgactgaggggcctcacacggaaccttgtgccctatctgtggtggcaaaccacatgacctgctgctcacaggttcccccacgccgcagaccgagtctcgctctgtcgcccaggttggactgcaatggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaaagctgttttctgattactcagagctgtcctaggcaatggtgctttgtagctccttggagatgtcgctgggcgtcctggcaggggtcaggcagtgaactgggagagtggttgcctccccagcacccgtgaccaccctggtcctgctcgtgtgggagatgctcgggccgtgtgtgcgccagggtccggggtgccgggtgtatgtggcagtcacctgacccgcgctgccagttatcatcggagctcatccatgtggccagtgaggtcacaggagaggacccggccacagcctctcagtggcctggagcacacgggggaagcgaccccccccaggtcccggctctgctgtggtcccctgtcccgtctgcccctggagcgacagtgtggtttcggccgcagcagaaacgtgactgagaacgcatccccgcgatgacctgacccttctgctcagggctgggactgtccctaggagttgagcaggaacaggcatctgtggtttacggcgacctggctctccgcgggccacgtgggtggtgagggcacacgagtgggaagcggcaccgacgtgtttctccccgaccgtggctttgccaaagacttttaatagcattttttaagtgcaaaacgtctaggtaaaaatctttatcatcagtgaccaaattagaatgtatttaatatagtaggtggtttaagaactgttttaacgtaagacaaactgatagcaacattctgttgttttaaaggaagtgggtccgtgacattctgcagctagtccactactccaaggtaactatcgacttggtttcagtgaatctattttgtttttaactacagtgatttattagctcagtatctagaaattacgtatattttgtgctactgtcatcgatgtgtaaactctgtttttatttgtatttatgcacttggttcccatttggagcctctggtcttttctgggataagtggtgtctgccgagacatctcccggttgtcagtggtcaggagcagctgagctctagtctgccagctgctctgctctttctgggaaggaggtggcgcccgcccctcagggtgtctccagggctcagcttccggggtggtagagctggggagccccaggggtggggggacagctgggagatggaggtggcacctgctcccctagatcagtactggctctgaggacaggtgagcagtgggaagaccaaagaatggctggcagcgctgccagggttggaaatgggggcaagatcctggggctgtgtgccctggggcctccctcacctgtcttggtggccatggcctcagggatggctcctaggtggctgaggcacagcagtggctggaaggtgccccgtggaggctgaggtggaggcgcgcccagcagctcccccctgtggccatggcgggcacggggcgtaggagctggctggcggccggctctgcatgttcttgttgcctgtcgtctgtaactctagtgttcgacattcgccgtgatacagtggtgtcacgacgtgtgtaactgtggtcagcagaccttgttccgcgtggacgcctcaagtggattaatttctggaagcctcaatctgtatgtttgagtatttacatgagaatgttatttgaatggaattttcttaacccagaaggtagtatttataatcatttacttgtagcgaactgtttaaagttaacacttgtttaaatttttttacactatagcatttatgcaatggtttacagaattcatggagttatttttatcagtatgggaattaattaaaaccttgaatctt

SEQ ID NO: 198267 - DNA, 3430 bp, Homo sapiens
  Payload ID: 19119
  Gene Name: unkempt family zinc finger-like
  ENST ID: ENST00000508903
  CDS Start-End: 1-2202
atgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtccacgccctgccccagtgtgaagcacggggatgagtggggggaaccctcacgctgcgatggcggcgacggctgccagtattgccactcccgcacggagcagcagttccatcccgagatctacaaatctacaaaatgcaacgacatgcgccaaaccgggtactgcccgcgcggccccttctgtgcctttgcacacgttgagaagagcctggggatggtgaatgaatggggctgtcacgacctccacctcacgagtccttcctccacgggcagcggccagccgggaaatgccaagcggagagactcgccggccgagggtggccctaggggcagcgagcaagacagcaagcagaaccacctggccgtgtttgcagcggtccacccgccggcccccagcgtgagctccagcgtggcgtccagcctggcgtccagcgccggctccggcagctcctcccccactgcgctgcccgcgccccccgcccgtgccctcccgctcggccccgccagcagcactgtggaggccgtcctcggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctc

SEQ ID NO: 198268 - DNA, 582 bp, Homo sapiens
  Payload ID: 19119
  Gene Name: unkempt family zinc finger-like
  ENST ID: ENST00000513783
  CDS Start-End: 355-582
aatgtgctgtgtcacggcagagccgggctgtgtcgcggtgactcagcggggccggtggtttcctaacgcccggggctgaggcagcctggcctgacccagctgtactcgcttaggtgaccagcctcacctagattttgcctctgcacaagggtcagctctttctttgagaatgtttcagaagatctgggtctaaccttgaaacagtgaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctg

SEQ ID NO: 198269 - DNA, 2301 bp, Homo sapiens
  Payload ID: 19120
  Gene Name: UPF0704 protein C6orf165  [Source:UniProtKB/Swiss-Prot
  Acc:Q8IYR0]
  Uniprot ID: Q8IYR0
  ENST ID: ENST00000507897
  CDS Start-End: 84-1952
caactgctccgaccgtcgcggtgagggccccaggacagaagcagacagacacggctcctgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccagccaccatgcagcatattgattaccagcttgagactgcccggagccaggtataccgctacacagccatccttgagaaggcagccaacgacccactcatgagggctgaacttcagccatatatgttaaaagaagcgctatataatatacgacaatatgaggtcttccttcagatcattttgtcagatataattactggtgctcaagaagtggaaatgatgacaaaacagttaggagcccatctggaacaactaaaaatgaccataaaatcaaagatagcggtcccaacatcacaagtctttcctatcttcattgcactttctactctgtggaccagcttgcaagacgaaactattgtggttggtgtcctcagtaatttattcactcacattcagccattcttgggtgctcacgaactatactttcctgagagagtgatgcaatgtcatcttaatggagcgactgtgaaaactgatgtgtgtagaatgaaagaacacatggaagatagagtaaatgtggcagatttcagaaaactagaatggcttttcccagaaacaacagcaaattttgataaactgttaattcaatatcggggattttgtgcttacacgtttgctgcaacagatggtcttctccttccaggaaatccagcaattggaattttaaaatataaagaaaaatattacacattcaatagtaaagatgctgcatattcatttgcagaaaatcctgaacattatattgacatagttagagaaaaggccaaaaaaaatacagagttaattcaactattggaacttcatcaacagtttgaaacatttattccatattctcagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagaaaaacagatttgggggaaaaagatatcaacagtttgattttggtgacttggtaacctagccaaggattttatgcctcctagtagttcttgttagatcagtagctggaag

SEQ ID NO: 198270 - DNA, 5348 bp, Homo sapiens
  Payload ID: 19121
  Gene Name: UPF1 regulator of nonsense transcripts homolog (yeast)
  Uniprot ID: Q92900
  ENST ID: ENST00000262803
  CDS Start-End: 273-3629
ggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgcgcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctgtaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttcacaccaa

SEQ ID NO: 198271 - DNA, 5311 bp, Homo sapiens
  Payload ID: 19121
  Gene Name: UPF1 regulator of nonsense transcripts homolog (yeast)
  Uniprot ID: Q92900
  ENST ID: ENST00000599848
  CDS Start-End: 210-3599
agctgaggcgcggaggggctcggcggcagcggcggcggctcggcactgttacctctcggtccggctggcgccggggcgcgcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctggtaatgaggatttagtcataatttggttaagagacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctgtaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttc

SEQ ID NO: 198272 - DNA, 5569 bp, Homo sapiens
  Payload ID: 19122
  Gene Name: UPF2 regulator of nonsense transcripts homolog (yeast)
  Uniprot ID: Q9HAU5
  ENST ID: ENST00000356352
  CDS Start-End: 475-4293
gctgaaatactgacattgaatattatatgaaatagtgaactgccatctttcatggttgtcaaatgctagggttaaagctgactcaaaatgttcacagatatattctgaagtatttacaattaaatgacatattgttttggagttgatagtggctgaatctgagtgatgggtacgtggaggttccttatattatgctctctacttttgtctgggcttggatttttccttataaaaagtaaaaaacaagtacttagacataggcctaactaataatgataggatgtggaatgtgatgaataacttattttgtaacagaaatagtattcattttacctgcctttatttactcttttacaattgccaagttgcattaatatgttctgtttaaaaaaatagtgtgatatcattttaaaaagtcactgcatctatggtactgacattctttccctcttacagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 198273 - DNA, 5193 bp, Homo sapiens
  Payload ID: 19122
  Gene Name: UPF2 regulator of nonsense transcripts homolog (yeast)
  Uniprot ID: Q9HAU5
  ENST ID: ENST00000357604
  CDS Start-End: 99-3917
gtggggggaggggaggggagagcccgagcgctggagttggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 198274 - DNA, 5369 bp, Homo sapiens
  Payload ID: 19122
  Gene Name: UPF2 regulator of nonsense transcripts homolog (yeast)
  Uniprot ID: Q9HAU5
  ENST ID: ENST00000397053
  CDS Start-End: 276-4094
gctggtagtggctaccttacgtattgccagtctgaaaaattcgctcttctcatcgactggggaatttgaaagagctgttaagtgaatggcactcatatgagcctttgccccggacccgccaccccagagtcaagctgagggcatcggcatgccgcagggaagacgatcaggactgtttttaatcgggcagtcgcgcggatggccttttccctctcgcctccttccgccccgcccccactctcagcccggccgcgctgattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattt

SEQ ID NO: 198275 - DNA, 2235 bp, Homo sapiens
  Payload ID: 19123
  Gene Name: UPF3 regulator of nonsense transcripts homolog A (yeast)
  Uniprot ID: Q9H1J1
  ENST ID: ENST00000351487
  CDS Start-End: 13-1344
ggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 198276 - DNA, 2387 bp, Homo sapiens
  Payload ID: 19123
  Gene Name: UPF3 regulator of nonsense transcripts homolog A (yeast)
  Uniprot ID: Q9H1J1
  ENST ID: ENST00000375299
  CDS Start-End: 57-1487
agctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaagtactgaaa

SEQ ID NO: 198277 - DNA, 494 bp, Homo sapiens
  Payload ID: 19123
  Gene Name: UPF3 regulator of nonsense transcripts homolog A (yeast)
  ENST ID: ENST00000492270
  CDS Start-End: 38-355
cgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgaggtgaggcccgccccgaggggaggaagagagggcggaacccagagctcggcggcggtggccgtctcgttgccttacgttccttaccctgatttctcctatatgggagtcgtgtgagctttttgaataaatacatttcagtaaaa

SEQ ID NO: 198278 - DNA, 2335 bp, Homo sapiens
  Payload ID: 19124
  Gene Name: UPF3 regulator of nonsense transcripts homolog B (yeast)
  Uniprot ID: Q9BZI7
  ENST ID: ENST00000345865
  CDS Start-End: 71-1483
gcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtg

SEQ ID NO: 198279 - DNA, 2378 bp, Homo sapiens
  Payload ID: 19124
  Gene Name: UPF3 regulator of nonsense transcripts homolog B (yeast)
  Uniprot ID: Q9BZI7
  ENST ID: ENST00000276201
  CDS Start-End: 71-1522
gcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtacacaggtttctgttacaagctgtgaatcagaaaaatctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaa

SEQ ID NO: 198280 - DNA, 1385 bp, Homo sapiens
  Payload ID: 19124
  Gene Name: UPF3 regulator of nonsense transcripts homolog B (yeast)
  ENST ID: ENST00000619445
  CDS Start-End: 44-697
gtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaaggagcgctgaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgc

SEQ ID NO: 198281 - DNA, 826 bp, Homo sapiens
  Payload ID: 19125
  Gene Name: upper zone of growth plate and cartilage matrix associated
  Uniprot ID: Q8WVF2
  ENST ID: ENST00000378681
  CDS Start-End: 74-490
agtggggacccaaagggtgcaggacgcctggtctgccttgtgggtcctggacggagcccctacctctgcaaagatgacttggagacaggccgtcctgctgtcttgcttctccgccgtggtgctcctgtctatgctgagagagggaaccagtgtatctgtgggcaccatgcagatggcgggagaagaggcgagtgaagatgcaaaacagaagattttcatgcaggaatcagatgcctcgaatttcctcaagaggcgcggcaagcggtcccccaagtccagagatgaggtcaatgtggaaaacaggcagaagcttcgggttgatgagctgcggagagaatattacgaggaacaaaggaatgaatttgagaacttcgtggaggaacaaaacgatgagcaggaagagaggagccgggaggctgtggagcagtggcgccagtggcactatgacggcctgcacccatcctatctctacaaccgccaccacacctgatcccatcctgaagccggccaagaagacaaagcttgtagcaccattggcatccccgtgttccagcaatctttcccatgcaaaccggcccttcagagggtctcagcttggggtctgcagtggccagcagctcttgaaaagacgcatgcctttccttccagtgtgtgaaagtgtcctgactttcacctctttgcagaccatcttctgaggtgagcaactgcctgcagggcctcctagtaccaaacctacagtggcttcccctggcttcgttcccaagcaaaagaatcagtcaagaatcacatgtttgcttatggcttacaaataaaaacgctgaatcaa

SEQ ID NO: 198282 - DNA, 763 bp, Homo sapiens
  Payload ID: 19125
  Gene Name: upper zone of growth plate and cartilage matrix associated
  ENST ID: ENST00000463405
  CDS Start-End: 77-427
agaagtggggacccaaagggtgcaggacgcctggtctgccttgtgggtcctggacggagcccctacctctgcaaagatgacttggagacaggccgtcctgctgtcttgcttctccgccgtggtgctcctgtctaatgcaaaacagaagattttcatgcaggaatcagatgcctcgaatttcctcaagaggcgcggcaagcggtcccccaagtccagagatgaggtcaatgtggaaaacaggcagaagcttcgggttgatgagctgcggagagaatattacgaggaacaaaggaatgaatttgagaacttcgtggaggaacaaaacgatgagcaggaagagaggagccgggaggctgtggagcagtggcgccagtggcactatgacggcctgcacccatcctatctctacaaccgccaccacacctgatcccatcctgaagccggccaagaagacaaagcttgtagcaccattggcatccccgtgttccagcaatctttcccatgcaaaccggcccttcagagggtctcagcttggggtctgcagtggccagcagctcttgaaaagacgcatgcctttccttccagtgtgtgaaagtgtcctgactttcacctctttgcagaccatcttctgaggtgagcaactgcctgcagggcctcctagtaccaaacctacagtggcttcccctggcttcgttcccaagcaaaagaatcagtcaagaatcacatgtttgcttatggcttacaaataaaaacgctgaatcaa

SEQ ID NO: 198283 - DNA, 364 bp, Homo sapiens
  Payload ID: 19126
  Gene Name: up-regulated during skeletal muscle growth 5 homolog (mouse)
  Uniprot ID: Q96IX5
  ENST ID: ENST00000309579
  CDS Start-End: 68-244
ccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaa

SEQ ID NO: 198284 - DNA, 560 bp, Homo sapiens
  Payload ID: 19126
  Gene Name: up-regulated during skeletal muscle growth 5 homolog (mouse)
  Uniprot ID: Q96IX5
  ENST ID: ENST00000337003
  CDS Start-End: 264-440
ccgagaggtggttacattcgttgaaggacaccagctgcggaatttgcggctttggcagacccagctgagtcactgtcactgcctaccaatctcgaccggacctcgaccggctcgtctgtgttgccaatcgactcggcgtggcgtcggtcgtggtagataggcggtcatgcatacgaattttcagctcttgttctggtgaccttttgaatacgtcttgtctataaaagaaattcatgcctttgtaaaatacacagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaa

SEQ ID NO: 198285 - DNA, 635 bp, Homo sapiens
  Payload ID: 19126
  Gene Name: up-regulated during skeletal muscle growth 5 homolog (mouse)
  Uniprot ID: Q96IX5
  ENST ID: ENST00000369811
  CDS Start-End: 339-515
atcaccggccgaattaacctcttttcttctgtatgtccatagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaa

SEQ ID NO: 198286 - DNA, 626 bp, Homo sapiens
  Payload ID: 19126
  Gene Name: up-regulated during skeletal muscle growth 5 homolog (mouse)
  Uniprot ID: Q96IX5
  ENST ID: ENST00000369815
  CDS Start-End: 330-506
ggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaa

SEQ ID NO: 198287 - DNA, 789 bp, Homo sapiens
  Payload ID: 19126
  Gene Name: up-regulated during skeletal muscle growth 5 homolog (mouse)
  Uniprot ID: Q96IX5
  ENST ID: ENST00000369825
  CDS Start-End: 484-660
cccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagacccagctgagtcactgtcactgcctaccaatctcgaccggacctcgaccggctcgtctgtgttgccaatcgactcggcgtggcgtcggtcgtggtagataggcggtcatgcatacgaattttcagctcttgttctggtgaccttttgaatacgtcttgtctataaaagaaattcatgcctttgtaaaatacacagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaagctggttgt

SEQ ID NO: 198288 - DNA, 5658 bp, Homo sapiens
  Payload ID: 19127
  Gene Name: upregulator of cell proliferation
  Uniprot ID: Q8TCY9
  ENST ID: ENST00000336086
  CDS Start-End: 2238-4904
ataattttcaaacatatgacaggaaagcatttttatgatactttcttgtattttacatgtgtcttatttttggaatcagaaaaacatatatggtgatattagtaattttcaaaaactgcactgcagagagctcccttgcccctgagtagggccgttggaagtgctgttctctgccgtcttggtccgactccgcctgatacacagacaggaaacttagcaaggcttagaagtgggctggagcccgagttgacagattggctggtgttataatttttaaaattactggctatagggtacagtggctcattattttttgttgagatgaggttttgccatgttgcccaggctagtcttgaactcctgggctcaagtgatccccttgctttggcctcccagatgctggaattacaggcatgagtcactgcaccctgctctaaaatgatactattctgactgcagcatccccctccacatttcatgttctgatgtgagcaagagagccttctctttctgcccatgtatttattatccatgtggactcactaattgctggttttcaatggttttaaatcagttactgtgtttatgtttgtgctcacattgtcctagatttgaccagtgagagttcctcaggctggctcctgtgcccatcatgttttcgagcatttccttactttctgaaataagatgctcaggctcctcctgttctttccttgccccagccatcattcaggatctccaaggagtccgtttcttttagcgtggaaggtattaaagggtgctaggcatgcccattgccacaacagtgtctttgcttcttggccctttccgtggacagttaggaaatagatgcatgtgtacactcgtatacacacagagatatgtgtgcacacctacatctacacacttaaacacatatgcacataagcatgcatatagaaatcacagttcacacgagtgcctccagttccattgcgcctctgcaagttctgctgtaactctccattctatgtttgtatgtcctttcttcagcagttagttagcaccctggctcctggcagaatcaatacatttactcatttgctcactctatgatacatctaaaatagtttagtctttttttttttttttttgagatggagttttgttcttgtcacccaggctggagtgcagtggtgcgatctcggctcactgcaactctgcctcctgtgttcaagtgattctcctgccttagcctccgaagtagctgggattacaggcgcctgccaccacgcctggctaatttttatatttttagtagagacagggtttcaccatgttggccaggccagtctcgaactcctgacctcaagtaatccgcccgcctcagccttccaaagtgctggaattgcaggcgtgagccaccacaccaggcctaaaatagtttattcttaattagactgcacttatcatagctatttaaaataattcaggatcaccccttccagaccacagtgttaacttcagatgaacatccttctagagttctgtatatatacctatagataaacatacacaattttattaaattgtaatcatactgtgcatacttttctgtagcctgactttcccccgactaattaatataacagctttccctaatatctcatccagcatctttttgtccacaaaagaaatccatagcgtattttttaatggctgcagaatttgaccataattccgttattgcactttgattttaaaaggcatcagtttttcgctattatatataaagctggcatcaacatctttgtaactaaatcttaattatttccttaggatagaagtggaattactgggcaaagggtatgtatatttttctgtctttctgaatgactgtatttgtgctctggccagcagttttggagagtgctggttttctagaccagtgtttctcaactgtgggtgcatatcagaatcattgagggcacttttaaaagcagtgatacccaggaccagctcccagagattctggtttcatggatctggggtgtgacccagggtttatagtttttaaaagctctccaagagattttatatgcggccagtttgataggtgaaagtggtattccatttttttaattataattttcttctgaaattgtttcaggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaa

SEQ ID NO: 198289 - DNA, 3563 bp, Homo sapiens
  Payload ID: 19127
  Gene Name: upregulator of cell proliferation
  Uniprot ID: Q8TCY9
  ENST ID: ENST00000402306
  CDS Start-End: 41-2809
aggaagcgaaggaggcgggagcggagacctcgctgcgctcatggcgtcgcccgggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaa

SEQ ID NO: 198290 - DNA, 885 bp, Homo sapiens
  Payload ID: 19127
  Gene Name: upregulator of cell proliferation
  ENST ID: ENST00000426198
  CDS Start-End: 396-885
actgtggggccgtcgtcgccgcgtgccgagcgtcctggcgcggccgaggggaagcagcggggctgcccgggttacgctggccacccgcacctggtcctgtggcttcgaccactagtcagcaaggccccggagaggccagcgaagaggaggggctcgttggctttacggagacgcgcggagcaccctcaaggtgccacacgctcgcctgctccctgttcctacatcctgggcgtcttcccaggctgtcatataactcctgagaatagtggttcttaactctgatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatgg

SEQ ID NO: 198291 - DNA, 3596 bp, Homo sapiens
  Payload ID: 19127
  Gene Name: upregulator of cell proliferation
  Uniprot ID: Q8TCY9
  ENST ID: ENST00000443736
  CDS Start-End: 176-2842
cggccgcgcggaggaagcgaaggaggcgggagcggagacctcgctgcgctcatggcgtcgcccggaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaa

SEQ ID NO: 198292 - DNA, 591 bp, Homo sapiens
  Payload ID: 19127
  Gene Name: upregulator of cell proliferation
  ENST ID: ENST00000455877
  CDS Start-End: 225-591
acgctggccacccgcacctggtcctgtggcttcgaccactagtcagcaaggccccggagaggccagcgaagaggaggggctcgttggctttacggagacgcgcggagcaccctcaaggtgccacacgctcgcctgctccctgttcctacatcctgggcgtcttcccaggctgtcatataactcctgagaatagtggttcttaactctatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctg

SEQ ID NO: 198293 - DNA, 4042 bp, Homo sapiens
  Payload ID: 19127
  Gene Name: upregulator of cell proliferation
  Uniprot ID: Q8TCY9
  ENST ID: ENST00000453200
  CDS Start-End: 495-3290
attttacaatgggtaccgtctcagagaggccagcaactcgtccaacacagcactgcaagtaagaagtaggaaagttattgttttgcttaataataaggccttacgcttcagggctaaagaaaagccttttcttacagaaattaaactccaattacagaaaggtgtgaagttcagtaaggccctggggcaggttatcctacagcttttggcaccgcaggcaccgcccggcgagttccggcctccaggcacctgggcaggtgggcgttgggcgggctgcgggctgacctgggccgccccgcccccaccccgccccagctgtccccgggctgctccgagaggaccccgggcccaccttaccccacctcaccccacctccacccctggagcgcgtcccggagcgggcgggcggccggcgggccaggcccctccccggcgccgagccgcggccgcgcggaggaagcgaaggaggcgggagcggagacctcgctgcgctcatggcgtcgcccgggatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatg

SEQ ID NO: 198294 - DNA, 365 bp, Homo sapiens
  Payload ID: 19127
  Gene Name: upregulator of cell proliferation
  ENST ID: ENST00000446958
  CDS Start-End: 53-343
gcggccgcgcggaggaagcgaaggaggcgggagcggagacctcgctgcgctcatggcgtcgcccgggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagatcaggatactgggcccagagcttccaaacaacctgccaagggccacacactgggcagaagtgttttctttgtctttttcccattgccttttactaccatgctacttaaaaaataaaaagttattccatgtctggaca

SEQ ID NO: 198295 - DNA, 592 bp, Homo sapiens
  Payload ID: 19127
  Gene Name: upregulator of cell proliferation
  ENST ID: ENST00000439702
  CDS Start-End: 50-592
ggagacctcgctgcgctcatggcgtcgcccggatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactac

SEQ ID NO: 198296 - DNA, 2074 bp, Homo sapiens
  Payload ID: 19128
  Gene Name: upstream binding protein 1 (LBP-1a)
  Uniprot ID: Q9NZI7
  ENST ID: ENST00000283628
  CDS Start-End: 255-1877
ctgggccgcgaggcgcggggagtggccctaagcgcggggctgtacggggagggccgaggcgtggggcgaacgccggggcggggtcggggcggggccgggggaggcggaagcggcgcgtgaacctaagtcggagtcgcgttgaagccagcgtccggccggcagagcggcgtcggcggggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatga

SEQ ID NO: 198297 - DNA, 4148 bp, Homo sapiens
  Payload ID: 19128
  Gene Name: upstream binding protein 1 (LBP-1a)
  Uniprot ID: Q9NZI7
  ENST ID: ENST00000283629
  CDS Start-End: 531-2153
gtcgcgttgaagccagcgtccggccggcagagcggcgtcggcggggttggccggggcggtgtggcgctagagcctgggcgggccgggggcaaggagtcaaggcttgggggcgggtgacgggcgggcggagggcttgcccccgtgtggtcctcggagcggcccgaggtccagcctcccagcggtcccggaggaggatgcgaccggggggccccgggcggggcggtcggcggcggctgcagcgctagcggcgcgggggctgggcggcggcgccggcatgaggcgcagggccggtgtccgcgggagggtggcgctgccggcggcccggccgctcccgctgcaattgctcgctgggctcgtcgtgccctgccagtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaa

SEQ ID NO: 198298 - DNA, 859 bp, Homo sapiens
  Payload ID: 19128
  Gene Name: upstream binding protein 1 (LBP-1a)
  ENST ID: ENST00000411650
  CDS Start-End: 275-769
cacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagtgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaagggcaggcccagatatgatgcaggcactgatgagggcagaggtagactgtaagactggtagaaatgcacatgggcagtactgatttcttgaagacgactgggtttgttgccaagaaaacaaaacttctaatttaggtcggttagaccccgtttaaccatctatgtctgccggg

SEQ ID NO: 198299 - DNA, 3669 bp, Homo sapiens
  Payload ID: 19128
  Gene Name: upstream binding protein 1 (LBP-1a)
  Uniprot ID: Q9NZI7
  ENST ID: ENST00000447368
  CDS Start-End: 163-1677
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagtgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgc

SEQ ID NO: 198300 - DNA, 581 bp, Homo sapiens
  Payload ID: 19128
  Gene Name: upstream binding protein 1 (LBP-1a)
  ENST ID: ENST00000456378
  CDS Start-End: 138-581
gtgcggggacgcagcgaggccaccccggctgggaacagccgcgtgggcggggccgcattgcactctctggacagttcctgggccgcgaggcgcggggagtggccctaagcgcggggctgtacggggagggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgat

SEQ ID NO: 198301 - DNA, 4997 bp, Homo sapiens
  Payload ID: 19129
  Gene Name: upstream binding transcription factor, RNA polymerase I
  Uniprot ID: P17480
  ENST ID: ENST00000302904
  CDS Start-End: 494-2788
agacacacaccagtggcgacaggggagagttggaaagacgcaggagagaagcaggaggcaggaggcagcggggatggagcaatgggagcgggaagcaggcaggtttccttgcaaatccccctccggcctcacgccgtctcgccggccccggcaggggagcgaggaccccggcgaacagatggaggagtggagctcgctctaggcagctgggcttggccggagaatggaggagccaccaagcgaccggctgattggaagagaaacgcagagcgatggaggcggggtaggaggacgatttctctgcggggactggcggcggcgtacacgcccgggtcgggcgctgcagagcttggctggctttcaacccgcgctcgccggctccagccccgcgcgcccccacccctagccctcccggcggctccgcagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttatttttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtttga

SEQ ID NO: 198302 - DNA, 4684 bp, Homo sapiens
  Payload ID: 19129
  Gene Name: upstream binding transcription factor, RNA polymerase I
  Uniprot ID: P17480
  ENST ID: ENST00000343638
  CDS Start-End: 292-2475
cggagcggcgctgcgctgcgccgaggcgggcgggcgggcgggcggagcggggcgggcggagcgcggcgcgtggggctcgccattagccgtcgctccgcttcgccatctcgggctttgtctggcgactcgctgccccggcgtcggctgcagcggagctgcggctcgactgttcggcccgccgtgctcccaggtgcccccggcctgcgctcccatccacacgctcgggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttatttttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtttga

SEQ ID NO: 198303 - DNA, 2683 bp, Homo sapiens
  Payload ID: 19129
  Gene Name: upstream binding transcription factor, RNA polymerase I
  Uniprot ID: P17480
  ENST ID: ENST00000393606
  CDS Start-End: 374-2557
gcggcggggggtgtgcgagctgaggccggggccggcggcgggcgggctgcctgcaggcggagggcgctgtgctttgtgcttttcgccgcgaggagcagcaggcagcagccacagccgccgccgccgccgccgccgccacagcagcagcagccgccgccccagcgccgccgcctcgcccggaggaggagccgctgccgccgcgggagggagctgcggctgtgcccggccgagcgggggagggcgccgccactcagagccagggagggagccgctggagcgggaagcccggaggccgcgctgcgccggggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttcttt

SEQ ID NO: 198304 - DNA, 2738 bp, Homo sapiens
  Payload ID: 19129
  Gene Name: upstream binding transcription factor, RNA polymerase I
  Uniprot ID: P17480
  ENST ID: ENST00000436088
  CDS Start-End: 122-2416
agagccagggagggagccgctggagcgggaagcccggaggccgcgctgcgccggggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagt

SEQ ID NO: 198305 - DNA, 674 bp, Homo sapiens
  Payload ID: 19129
  Gene Name: upstream binding transcription factor, RNA polymerase I
  ENST ID: ENST00000529373
  CDS Start-End: 92-674
caagactgggctccctggcagcacccacggaccccgaccctctgcacctggacagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatct

SEQ ID NO: 198306 - DNA, 3010 bp, Homo sapiens
  Payload ID: 19129
  Gene Name: upstream binding transcription factor, RNA polymerase I
  ENST ID: ENST00000527034
  CDS Start-End: 183-2420
gggctttgtctggcgactcgctgccccggcgtcggctgcagcggagctgcggctcgactgttcggcccgccgtgctcccaggtgcccccggcctgcgctcccatccacacgctcgggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccg

SEQ ID NO: 198307 - DNA, 2459 bp, Homo sapiens
  Payload ID: 19129
  Gene Name: upstream binding transcription factor, RNA polymerase I
  Uniprot ID: P17480
  ENST ID: ENST00000526094
  CDS Start-End: 274-2457
gcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgagg

SEQ ID NO: 198308 - DNA, 721 bp, Homo sapiens
  Payload ID: 19129
  Gene Name: upstream binding transcription factor, RNA polymerase I
  ENST ID: ENST00000530828
  CDS Start-End: 274-721
gcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggccc

SEQ ID NO: 198309 - DNA, 685 bp, Homo sapiens
  Payload ID: 19129
  Gene Name: upstream binding transcription factor, RNA polymerase I
  ENST ID: ENST00000529947
  CDS Start-End: 1-110
aggagcactacaaaaagctggccgaggagcagcaaaagcagtacaaggtgcacctggacctctgggttaagagatgggcaggctggtctcgaactcctgacctcatgtgatccgcccacctcggcctcccaaagcactgggactacaggcttgagccaccgtccgcagccactatcacccttttaaaaataaggaaaccaaggctcagagaggttaagtaacttgcccaaggtcacacagtaagtagaagaatccaaatcagactgccttttcctcccccatctgggaccacgggacctctcctagactcctggcctttgtgcttcccctctgtgctttggttgagtagtcagatctgtaaagtggagagaatcacctgtgtccttcccactcaccaaggcaggttggccaaggacccaggaagactgtggggatttgctgtttcaggagtttgagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtcc

SEQ ID NO: 198310 - DNA, 2570 bp, Homo sapiens
  Payload ID: 19129
  Gene Name: upstream binding transcription factor, RNA polymerase I
  Uniprot ID: P17480
  ENST ID: ENST00000529383
  CDS Start-End: 274-2568
gcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgagg

SEQ ID NO: 198311 - DNA, 3011 bp, Homo sapiens
  Payload ID: 19129
  Gene Name: upstream binding transcription factor, RNA polymerase I
  Uniprot ID: P17480
  ENST ID: ENST00000533177
  CDS Start-End: 181-2364
cttggctcggctccccggaggccggggcgggggcgccggcggggctgggccgcaggctcgggggaggaggcggcggttcccgccgcggtcgcgcctctgtgccgggctcctccggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctacc

SEQ ID NO: 198312 - DNA, 1182 bp, Homo sapiens
  Payload ID: 19130
  Gene Name: upstream binding transcription factor, RNA polymerase I-like 1
  Uniprot ID: P0CB47
  ENST ID: ENST00000530464
  CDS Start-End: 1-1182
atggctttgcctagaagccaaggccattggtccaacaaagacatcttgaggttactggaatgcatggagaataatcgcccatctgatgacaacagcacgtttagctcaactcagtcacacatggactggggaaaagtagcttttaaaaacttttctggtgaaatgtgcagactcaaatggttagagatttcttgcaacttgagaaaattcggcactttgaaagaattagtcctggaagctaagaaatgtgttaaaaagatgaacaaaagccaaaaatacaggaacggtccagactttccaaagaggccccttactgcttacaatcgcttcttcaaggagagttggccccagtactcccaaatgtaccctgggatgagaagccaggaactgaccaaaatcctgtcaaagaaatacagggaactcccagagcagatgaaacagaaatatattcaggatttccggaaggaaaagcaagaatttgaggaaaaacttgctcgattcagggaagaacaccctgatttagtccagaaggccaagaaatctagtgtctccaagaggactcaaaacaaagtgcaaaagaagtttcagaaaaatattgaagaagtgaggtctcttccaaaaacggatcgatttttcaagaaggtaaaatttcatggagagcctcagaaaccccccatgaatggataccacaagtttcaccaagattcctggtcaagtaaagagatgcaacatttgtcagtgagggagcgcatggtagagattggcagacgctggcagcgcatcccgcagagccagaaggatcattttaagagccaggctgaggagctgcagaagcaatacaaggtgaaattggatctctggctcaagactttgtcacctgaaaattatgctgcatacaaagaatcgacctatgctaagggtaagaatatggccatgacaggaggcccggaccccaggttgaaacaagcagatccacagtcctcatcagcaaagggtctgcaagaagggtttggggaggggcaagggctccaggctgcaggaacagattcatcacagactatttgggtaaactgtcatgtctccatggaaccagaagagaacaggaagaaagatagagaaaaggaagaaagcagtaactcttcagactgcagcagtggagaagaaatagaagttgatgtctga

SEQ ID NO: 198313 - DNA, 998 bp, Homo sapiens
  Payload ID: 19131
  Gene Name: upstream transcription factor 1
  ENST ID: ENST00000368019
  CDS Start-End: 85-933
acttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatccc

SEQ ID NO: 198314 - DNA, 1717 bp, Homo sapiens
  Payload ID: 19131
  Gene Name: upstream transcription factor 1
  Uniprot ID: P22415
  ENST ID: ENST00000368020
  CDS Start-End: 116-1048
tccattgaaaattttccttggataggaaaggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggggtcgttttttttttttcttttcttttttttttttttttttttttttttttaagataaaattgttcaaagcca

SEQ ID NO: 198315 - DNA, 1807 bp, Homo sapiens
  Payload ID: 19131
  Gene Name: upstream transcription factor 1
  Uniprot ID: P22415
  ENST ID: ENST00000368021
  CDS Start-End: 206-1138
gcccctcaccaacatggccgcgggctggaagtgcgcatgagcagctgtctatggagatacctaggccgggagagggagaacacagttggagaaaatcggcagctgagacggccttggccggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggggtcgttttttttttttcttttcttttttttttttttttttttttttttttaagataaaattgttcaaagcca

SEQ ID NO: 198316 - DNA, 610 bp, Homo sapiens
  Payload ID: 19131
  Gene Name: upstream transcription factor 1
  ENST ID: ENST00000534633
  CDS Start-End: 294-610
gagacggccttggccggacttagcactcaggcctgtgaatcaggagatacaaagacctccaaaaaaggaccagttcctcggatgtgccccctcacagagagatgaaggggtgagtgaagaagaggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtc

SEQ ID NO: 198317 - DNA, 505 bp, Homo sapiens
  Payload ID: 19131
  Gene Name: upstream transcription factor 1
  ENST ID: ENST00000528768
  CDS Start-End: 1-496
gagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtca

SEQ ID NO: 198318 - DNA, 720 bp, Homo sapiens
  Payload ID: 19131
  Gene Name: upstream transcription factor 1
  ENST ID: ENST00000531842
  CDS Start-End: 68-720
gtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcg

SEQ ID NO: 198319 - DNA, 1092 bp, Homo sapiens
  Payload ID: 19131
  Gene Name: upstream transcription factor 1
  ENST ID: ENST00000473969
  CDS Start-End: 191-337
ggccgcgggctggaagtgcgcatgagcagctgtctatggagatacctaggccgggagagggagaacacagttggagaaaatcggcagctgagacggccttggccggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaa

SEQ ID NO: 198320 - DNA, 1634 bp, Homo sapiens
  Payload ID: 19132
  Gene Name: upstream transcription factor 2, c-fos interacting
  Uniprot ID: Q15853
  ENST ID: ENST00000222305
  CDS Start-End: 38-1078
ccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccc

SEQ ID NO: 198321 - DNA, 1523 bp, Homo sapiens
  Payload ID: 19132
  Gene Name: upstream transcription factor 2, c-fos interacting
  Uniprot ID: Q15853
  ENST ID: ENST00000343550
  CDS Start-End: 125-964
ctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 198322 - DNA, 648 bp, Homo sapiens
  Payload ID: 19132
  Gene Name: upstream transcription factor 2, c-fos interacting
  Uniprot ID: Q15853
  ENST ID: ENST00000379134
  CDS Start-End: 1-648
atggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 198323 - DNA, 1173 bp, Homo sapiens
  Payload ID: 19132
  Gene Name: upstream transcription factor 2, c-fos interacting
  ENST ID: ENST00000599471
  CDS Start-End: 1-762
gtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgccctaaggctcctggtcccctcgccccccagagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggcc

SEQ ID NO: 198324 - DNA, 510 bp, Homo sapiens
  Payload ID: 19132
  Gene Name: upstream transcription factor 2, c-fos interacting
  ENST ID: ENST00000598058
  CDS Start-End: 1-510
acccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggtaggtgccctgccacccctgggtgggggggggagggagtggagaggggacactggctctgctcttggggagccccgggggtggggcaggtgtc

SEQ ID NO: 198325 - DNA, 446 bp, Homo sapiens
  Payload ID: 19132
  Gene Name: upstream transcription factor 2, c-fos interacting
  ENST ID: ENST00000599625
  CDS Start-End: 1-446
tttcaaatctaatacttagcagatgcttgggcaaacagctctgcgataatacatgccccctttttttttcctcctcttgtagaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacc

SEQ ID NO: 198326 - DNA, 464 bp, Homo sapiens
  Payload ID: 19132
  Gene Name: upstream transcription factor 2, c-fos interacting
  ENST ID: ENST00000597671
  CDS Start-End: 1-259
ggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagttccttgaaattcgatgagacttacccgacgggcccgaatgtgtcctagcttggcggaagcttctggggcattgacgaggacaggtgtctgctgctgtcaggcagaatgtccccccagtggagcggaggcggagggacaagatcaacaactggatcgtccagctttcgaaaatcattccagactgtaacgcagacaacagcaagacgggagcg

SEQ ID NO: 198327 - DNA, 1612 bp, Homo sapiens
  Payload ID: 19132
  Gene Name: upstream transcription factor 2, c-fos interacting
  Uniprot ID: Q15853
  ENST ID: ENST00000595068
  CDS Start-End: 38-1054
ccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccg

SEQ ID NO: 198328 - DNA, 1179 bp, Homo sapiens
  Payload ID: 19132
  Gene Name: upstream transcription factor 2, c-fos interacting
  ENST ID: ENST00000594064
  CDS Start-End: 1-1050
atgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccc

SEQ ID NO: 198329 - DNA, 550 bp, Homo sapiens
  Payload ID: 19132
  Gene Name: upstream transcription factor 2, c-fos interacting
  ENST ID: ENST00000596380
  CDS Start-End: 122-550
agtgatcgctgacctcccgccatgttccagggctgtttgaaacacaggacagaatgctacacgcagaaggagtccccactcctgttaattgcagagaatgcagtaaaccccaagcacagcaatgaggggacgggatggaggaacagagaaagctaagggtagcctctgccctcctactccccaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgt

SEQ ID NO: 198330 - DNA, 582 bp, Homo sapiens
  Payload ID: 19132
  Gene Name: upstream transcription factor 2, c-fos interacting
  ENST ID: ENST00000602164
  CDS Start-End: 1-339
atgctggacccgggtctggatcccgctgcctcggccaccgctgctgccgccgccagccacgacaagggacccgaggcggaggagggcgtcgagctgcaggaaggtgagtgcttgccgggccggccgcgcccggggagggctgggggcgctcggcgcggccctgaccgtgccccgaccctcctcggccccaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatt

SEQ ID NO: 198331 - DNA, 13708 bp, Homo sapiens
  Payload ID: 19133
  Gene Name: upstream transcription factor family member 3
  Uniprot ID: Q68DE3
  ENST ID: ENST00000316407
  CDS Start-End: 412-7149
ggctgggaaagttgaggccgcgctgccgccgggtctccggccttgagggctcgggctcgcagcggctgcggtggccgcaaaaagaggcggcgggggcggggggagaggagggcctgggcccgcgctcccccagccccggaggagcaggcggtggccgcggacggagagattcgcccagacggtcagacactcctgccttcccctcctgggatcatgacccaggcgggggtcgccgccgtcgccgccgccaccgcggccgagaccgcgcagccggcggtaagaagaaagcataacccatagaccatcttctggcagaagatgatacatttggatcagaaacgggaggcattggaagccaggaatcaaaagtgaagaaactctgcaagcccttaggttcctattactgtaaccatgccagaaatgacagagaatgagacgcctacaaaaaagcagcacagaaagaaaaaccgggagacacacaatgcagtggagaggcatagaaagaagaaaattaatgctgggataaacagaataggagagctgatcccatgttctcctgccctgaagcagagcaagaatatgatcctggaccaagcctttaaatatataacagaattgaaaaggcaaaatgatgaactcctgcttaatggaggaaacaatgaacaagctgaagaaataaaaaagctacggaaacaactggaagaaatccaaaaagaaaatggccgatatattgaattactgaaagctaatgacatatgcttatatgatgacccgacaattcactggaaaggaaatcttaaaaactcaaaggtctctgttgttattcctagtgaccaggttcaaaaaaaaattattgtttattccaacgggaatcagcctggtggaaacagccagggaacagctgttcaggggataacttttaatgttagtcataatttacaaaagcagaccgccaatgtggtgccagtacagaggacttgcaatcttgtgactcctgtatctatttctggagtttacccttctgaaaacaagccatggcatcagaccacagttcctgcattggctaccaaccagcctgttcctctttgtcttcctgctgccatttctgctcagagtattctcgagcttcccacctctgaaagcgaatcaaatgtgcttggtgccactagtggctcactgattgctgtttcaattgaatctgagcctcaccaacatcattctttgcacacatgcctaaatgatcaaaattcttctgaaaataagaatggacaagagaaccccaaagtattgaagaaaatgaccccttgtgttacaaacatcccccacagctcctcagcaactgccactaaagtgcaccatggaaacaagtcctgcctgagcatacaggacttcagaggtgattttcaaaacacttttgttgtttcagttaccaccacagtctgctcgcagcctcccagaactgcaggtgattcttctccaatgagcattagtaagagtgcagacttgacaagtacagctacagtggtggcatcatctgcccctggagtagggaaggccaccattcctataagcactctttcgggaaaccctttggacaatggttggactctttcttgttctttgccttcttcaagtgttagtacttcagatttgaaaaacattaatagccttacacgaatctcttcagctggaaacacacagacaacgtggactactttgcaactggcaggaaacactattcagcccttaagccagacaccatcttctgctgtgactccagtattaaatgagtctggtactagccccaccacaagcaaccacagtagatatgtggctacagacatcaacttgaataattcctttccagcagatgggcagccagttgagcaagtagttgtaacattgccttcttgtccatctttacctatgcagccactaattgcccagccacaagttaaatctcagcctcccaaaaatatccttccactgaattcagcaatgcaagtgattcagatggctcagccagttgggtcagctgttaattcagctccaactaatcaaaatgttataattcttcagccacctagcaccaccccatgcccaacagtgatgagggcagaagtttccaaccaaacagtaggtcaacagatagtaatcatacaggctgctaatcagaatcctttgccactcctccctgctccacctcctggttctgttcgactccccatcaatggagccaatactgtaatagggtctaataattcagtgcaaaatgttccaacaccacagacttttggaggaaagcatcttgtccacatattaccaagaccttcatctttatcagcgtctaactcaacacaaactttttctgttaccatgtcaaaccaacagcctcaaaccatttctttaaatggacagctctttgctttgcagcctgtgatgtcttcatcaggaactacaaatcaaacccctatgcaaattattcaacccaccaccagcgaagatccaaataccaatgttgccctgaatacatttggtgctttggccagcctcaatcaaagcatatcacagatggctgggcaaagctgtgtacaattgtctattagccagcctgccaattctcaaactgctgcaaatagtcaaaccactacagctaactgtgtttcattaacaacaactgcagcacctcctgtgacaacagatagttcagccacactagctagtacttataatctagtgagtacttcctcaatgaacactgttgcttgtttgcctaacatgaaatctaaaaggttgaataagaagccaggtggcaggaaacacttagcagcaaacaagtcagcgtgtcccctgaattcagtcagagatgtgagcaagttagactgccccaacactgaaggctcagcagagccaccctgtaatgatggactgctagaaagcttccctgctgtgttaccatctgtctctgtgtctcaggcaaatagtgtgagtgtttctgcttcacattctttgggtgttctaagctctgaatcattaatacctgagtctgtatcgaaatctaagtcagcagaaaagtccagcccaccctcccaagaatctgtaacaagtgaacattttgcaatggccgcagcaaaatccaaagattctacccctaatctacaacaagagacatctcaggataaaccaccaagtagtttagcattatcagatgctgccaaaccctgcgcttcagccaatgtattgattccatctccaagtgatcctcacattttggtttctcaggttcctggtttgtcatctacaacaagcactacaagtactgactgtgtttctgaggtagaaatcattgctgaaccttgcagagttgagcaagattcatcagatacaatgcaaaccacaggtctcttaaaggggcaaggtttaactacattgctatctgatcttgctaaaaaaaaaaaccctcagaaatcatctctttctgatcagatggatcatcctgacttttcttcagaaaatcctaaaatagttgattcaagtgtgaatttacatcccaaacaggaactattactgatgaacaatgatgatagagatcctccacagcatcattcctgcctccctgatcaagaggttattaatggttctttgatcaacggtagacaggccgactctcccatgtcaaccagctctggcagtagtcgtagtttctcagttgcatccatgcttcctgaaacaacaagagaagatgtgaccagcaatgcaacaactaatacatgtgacagctgtacctttgtagagcaaactgatatagtagctcttgcagcaagagctatttttgaccaggagaaccttgagaaggggagagttggcctccaggctgatataagggaagttgcttcaaagccttctgaagcatcattgttagagggagacccacccttcaaatcacagatacctaaagagagtggcacaggacaggcagaagcaacaccaaatgaatttaattctcagggttcaattgaagcaactatggagaggccccttgagaaaccaagttgttctctaggaattaaaacatcaaatgcatctttacaggattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgtccctgatgagcagaactccagacaccatttctgaccaaactcaaatgatggtcagtcagatccctcctaattcttcaaactcagttgtgcctgttagcaacccagctcatggagatggccttacacgattatttccacctagtaacaactttgtgactcctgcattgaggcaaactgaagttcagtgtggttctcagccttcagttgctgaacagcagcaaacccaggcaagtcagcatctacaggccctgcagcagcatgttccagctcaaggtgtatctcaccttcatagtaaccatctctacataaagcagcagcagcagcagcagcagcagcagcagcagcaacagcaacaacaacaagcagggcagttaagagagaggcatcacttatatcaaatgcagcatcatgtacctcatgcagagagctctgtccactctcagccccataatgtccaccaacagaggactctgcaacaggaagttcagatgcagaaaaagaggaatcttgttcagggcacccagacctctcagctttccttacaaccaaagcaccatggaactgaccaatcccgatccaagactggccagccacatccccaccatcagcagatgcagcaacaaatgcagcaacactttggaagctcccagacagagaagagctgtgaaaacccttcaactagtcggaaccatcataaccatccccagaaccatctcaatcaagatattatgcaccaacagcaggatgttggaagcagacagcaaggttcaggggtttcatctgaacatgtatctggccataatccaatgcagaggcttttgacatcaagaggcttagagcagcaaatggtgtcccaaccaagtattgtgactagatcttcagacatgacctgtactccacacaggccagagagaaatagagtttcaagttattctgctgaggcactcattggaaagacatcttctaattcagagcagagaatggggatatcaattcagggttccagagtttcagatcagcttgaaatgagaagctatcttgatgttcccagaaataagagtttggctattcataatatgcagggtcgtgtggaccatactgtggcctcagatatccgcctttctgattgtcagacgtttaaaccaagtggagctagtcaacagccccagagtaattttgaagtacaatcttcaagaaacaatgaaataggtaaccctgtatcatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatcttcctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattccacaggttactcagcctagtgccactcgaactccagccctcatcccggtagatccgcaaaatactctgccctccttctatcctccatactctcctgctcatcctacactgtccaatgatatttcaatcccctattttcctaatcagatgttctcaaatcctagcacagagaaggtaaacagtggaagtttaaataaccgatttggatcaattttatctcctcccagacctgttgggtttgctcaaccaagttttcctcttctcccagatatgccaccaatgcacatgaccaactctcacttatccaattttaatatgacatctttgtttccagaaatagccacagcgcttcctgatggctcagcaatgtcacctttgcttacaatagcaaattcctctgcctctgactcttccaagcagtcctcaaacagacctgcccataacataagccatattctaggtcatgattgcagttcagctgtttaaatactgataaacaaaatgtaaaggtaatgagtgagattacaaatgtatttgtgcgtgcatgtgcacagacatgtacatgaagagaaggattgtgtgtgtgtgtctgtataatcagttttcagttatcttctgaatgtagggaagccatgtcagatgcagatactgggttgtcagaaaacaagttatctttcgttttcaactgcatggtgtacttttttattttccaagtagatttacatttccaagttgatatttcctaaatactaattagctggaaattgggggagatcatcttgtcatgtactgggtagtaggagggagcctagactttaaacttgattgttgataacttatggaatatgtaggtaagttgctactgaaaaatataggcagcttgataaaacacagtggctcataatcaagtgctggctaatgtcagcatctagaacagcttcttacctatgacagatgttgaactgatgttgagtttaatgtccgtagttaaagtcaagcagttagcaaataaataaaagcaatcagcctttattctcaaagtttggtttagatacaggcttctttctaaattataacaatgcataaattatctgaattttatgtcttgttcttcaaattagggagctgtgttaccctttaatgtgccaagattatttaaagcaaaggtcttccttagacaattatttagccgtaaatatagaaagctaaaaagttaagtacatacatattctccgttttgtgcttgcattttgcatcgggtcataagggtaaaagcagttagttgtattgtggagttttgcatgggtgcagttaacaatggatgtttcatcagctgagtttaatttagtattctctcttcattctatttatttggtcttgaaataaattcttttgcattcatttaaatattaggattgatcaggaaatagtgtttgtaatctacacgtttatttgagccttactttaaaaatatttctgaacagagatttaagctctgtcagtattttcatttactgatagcatttatattttaaatatggcattgtatatttcattattatccttcataacagaattataatgagaatatgaatttgttatttttcttgttggtagatgtgaaatggtgcttcaaaaaatatatagtctttctgtatgtctctgtgtgtgtaagtatgtgtgtgtgtgtgtacacatattttaaagtatgaattggtcctttaaaaacaggcctgccatctgaaaatgggaaattgagacctgagacctgctaaagcatagaagaacttgatataggtagggttttttttttttttttttttttaatagatggagtctggctctgttgcccaggctggagtgcagtggcgtgatctcagctcactgcaagctccacctcccgggttcaagtgattctcctgcctcagcctcctgtgtagctgggactacaggcacgtgccaccacacctggctaatttttggtacttttagtagagacggggtttcaccgtgttagccaggatggtcttgatctcctgacctcgtgatccacctgcctcggcctcccaaagtgccaggattacaggcatgagccaccgtgcttggcctaggtacaggtttttaaaagccccacagaagtttataatacgtttaaaaacccatattaaaatttgaaaacttaaaaaaaaaactaagaaaacaatggcatatattccttttcttaaacctgtgaagtccattactttttgttcttgttatattctgccaaaaatgggatggggtgggagagatgcatagaaattgttttatctgccttgttaacaaagtgaactcaaggaccagcttttcttttctttcttcttttcttttttttttgagactctgtcacccaggctggagtgtcgttaggtgcaactaacaccaggaacagcaccttgaatattcctttttcaagttcctcttcctcaggagatattcaaggtcactttgtcacccaggctggagtctacaatggcaggatcttggctcactgcagcctctgcctcctgggttcaagcaaattcttgagcctcagcctcccgagtagctgagattacaggtctgtgccactacacctggctaatttttatatttttagtagagacggggtttcaccatcttggccaggctggtcttgaactcctgatgtcaggtgatccacccacctcggcctcccaaagtactggaattacaggcatgagtcacccctcccaggcccccccctttttttttaatcctaaaaagcttcctaagggttggtcagagcagttaactccagtgaatacctcttctaaagactcagcaaaagggtcatttgtgcctctttaactgttcttaccaaactgtcctgtctcttttctgctgccaactaagcagcttcctagggacaaaaaaatatacaatatttttttttttcttgcttacaaagcaagaacaacctgtattttctttcttcaaaatggtcttggggaagaataggagagcttcatgaataagttactcaagacaacagataaacacagtagtcaaaactttttattgaggaaaaatgtggcatttatgacttgctttttaattctcttaactgaattttaagctgcaacgttcaaatttttctttgtacttgaaaggtccagtgtgccaatttcaagaaggacagttttccatgtgtttggctattcatttccctctctccctctctcatctgtctgtctctcactgcctctgtctctgtctctcatacacatatacacacacacacacacacacacacacacacactctctctctctctctctctctctccagtggctgttaagttctgaaggactggggactgctagacataattgaaagtaaggtaacaggctaaggagaagctcagtttgaacattgcaatgtaaagtcctcaaagcctgtgactttcaagtatttctgttgcattaattgtattttcctgcttagctgtgttcagacatagtatttgcatttcttggagctttcattccaacagtctaacattttgatcttgaaagagtctcaataagccttatttgaccatctgaggaaaaatgtgaccatctgtgaataattggctcctgcttacgtgtagctctcattactttacagatgtatgcatgtgtatgtaagacttcagttcatacatggcttaattctgaaagtgttcagaccatagtacccttatttgatttaaaagcatgaatatatgagatttactagcagtattaagtatttgatagagctacgtgatttttgggaagaaatttgttatatggtatgtagtgttaatttggatataatttttggtaaagggatggcagaaaacatagtcaattttggttataataaacgtaaccttattcttggcctgctccatgtgaaatagggctcagggaagctggtcttttccttagcgggatgattactcctttgccttgaaacatttattgggcccaccatgtatggatcagcatgtggtggtaagtcatactcccaaatcagtgattcccaagtcttggctttgggaaccagtatgcctcgtattctcttaaagagcaacaagaatttcttgaaacaaaattagttcagaattgatttaaattttttaacttctggaaatacacgaagttatgtctgagtcatgagtgacagtcattgattaaatcatttctctgtctcttttttagcattattgatcacagagtccgttataaaaagtggttgattcctttcaacatttaacaataacttctaatgaagggtaaaattccagattctcttcatgcgtaaacatttaatgtgtcaatcatagatgaaaggaatctagtttgatgttgtttctttctttcttttttttggaaaacacaagttgctctgggatggcttatatgttgttttataccggttcaggaaatttatttttgtttttattgtaagaccttttgcggtaccagagatggcaccttttttctaggtaaggtgtaggaattcctcaatggtcttgcttcgtaaaatttaacatatcagaactggggaaagagaaaggagggggttatttttttgcagcattttccagtcacatatcagggttatactgaactgcaacaaagatcaacttttaaaaattagccttcttaaaatacaaaatgatttaagtattttaaagataatttatttgccttgctcttgccttctaacattagccatttcatggagaggctaaaacttatactccaaaaaatgtggaagcacattttaatgggagtaaaattaaaaaattttgagaaagggtaaaatcttatgaatatgcatcttcttagctttatcttccctttgataggtaggcacttatgctcttccatctgctccatgtcaaatagggctcagggaagccagtcatttccttagcgagatgattactcctttgccttgaaacatttattgggcccaccatgtatggatcagtgtgtggtagtgagtcatactcccaaatcagtgattcccaagtcttggctttgggaaccagtatgccttgtattctcttaaaaagcaacaataatttcttgaaacaaaattagttcagaattgatttaaaatatttcagtgtgccatatagctctgtcccttggtttggttggccttgttttttcctgtgaagaatgaaagggcaaaggtgataccaaaatgaaacagctttggagtgatatctttaggagcctggaagccatttttgtaattttgttgtctatataaatgctacctttgcctggaggtagtgcgcctgtggctgtgtacatccagagggcaacagtaatagccaacaaccagacaaactagtgaagttaatctgtgagtgatgattttatgatacttatatgcaaattaaaggcagaagttagtttcttctcaagatgcctttttggctgaacattaccatttttctttccccagggtttgaaagaaaagggccttttttggatttaactatattctgtctgcattctattcttcatgcgtaggtttctactagaacctgtggaggggggacaccaaatttagattgagtcagtccatgctgataagaagcgtgaggaccttgttggacacagagcttctagatctttccacctgtagcctctaccctgttcctgcactttacctgaaactgtgcctctggtctttagaccagctgttggaacatatcactcacccactcctctgttatagcaaagggccagctgggatggtacacgctgtgtaatcagacaccttctcgacaagtacagctgatgtttctcactgttgccttaccattctctgagccatctttgatgttgatttgtaaaaaaaaacaaaaaacaaaaaaaaaacctagtagcaaaactcctgttaaactcagagcttgtatgtggtggtcattcaacatccttatttctagatttacacaaactgtaccaactgtaatctttttctggcacgcgtatgtggtcagatgcttcataaacgtgagccaacttgggttgtaaacattggacataatatacaaattggggaattttggatgactgcataatcctgtcattagagatttcataagacagaagataactgtttatttgtaatttaacacatttttagaaaagatgatctttaatttctttccctcagttgtgtatacagctatacaccatactaacaccgtactatgtcataggaacttaaagttagatgtatctaaatcccttcacttttctaagacttctctgtgctcccacccctgaagtcttcaaatcatttttcatctgtgaagtcactgaggtactgggcttgactatagtggtaacagttaaggggagttgaactattgatcttccaagaagaaagggaccagatagtgttaagatgctgcagttgtgttactgtgaagaaaagattcgcttccactttcagcaggctatataaatatatatacatatatatatatattttcactttggtaaaaaaaagttgaaaaatctgaggagaacataattaccttcacaaattatttatagatacactgggtgagaagcttactgtagggcagtcacccaaaaaaaactaattttagtgctttcaatagtgtaatatttgtatctattaccatggcagcagtgtctgctgcacactgtgtcctattactgtaaatctcctggtttataattcttatggaaactaatttgttttgtaatggaatccagagcagatatgtataatatgatcaggattgtcctacagttgtaaataagaataggtcctgtttattttgacatctttttacaaatgcattgtattagggtgtgaatattctgaaccatcctcttgtttaaagtttggaaatttttattgttaaatgtaacattttaatggttgtaataattatttgtatagatatgaatatagtattttatttaagaaaataaactttgcatttttgcattgtaaa

SEQ ID NO: 198332 - DNA, 8461 bp, Homo sapiens
  Payload ID: 19133
  Gene Name: upstream transcription factor family member 3
  Uniprot ID: Q68DE3
  ENST ID: ENST00000478658
  CDS Start-End: 19-6756
gttcctattactgtaaccatgccagaaatgacagagaatgagacgcctacaaaaaagcagcacagaaagaaaaaccgggagacacacaatgcagtggagaggcatagaaagaagaaaattaatgctgggataaacagaataggagagctgatcccatgttctcctgccctgaagcagagcaagaatatgatcctggaccaagcctttaaatatataacagaattgaaaaggcaaaatgatgaactcctgcttaatggaggaaacaatgaacaagctgaagaaataaaaaagctacggaaacaactggaagaaatccaaaaagaaaatggccgatatattgaattactgaaagctaatgacatatgcttatatgatgacccgacaattcactggaaaggaaatcttaaaaactcaaaggtctctgttgttattcctagtgaccaggttcaaaaaaaaattattgtttattccaacgggaatcagcctggtggaaacagccagggaacagctgttcaggggataacttttaatgttagtcataatttacaaaagcagaccgccaatgtggtgccagtacagaggacttgcaatcttgtgactcctgtatctatttctggagtttacccttctgaaaacaagccatggcatcagaccacagttcctgcattggctaccaaccagcctgttcctctttgtcttcctgctgccatttctgctcagagtattctcgagcttcccacctctgaaagcgaatcaaatgtgcttggtgccactagtggctcactgattgctgtttcaattgaatctgagcctcaccaacatcattctttgcacacatgcctaaatgatcaaaattcttctgaaaataagaatggacaagagaaccccaaagtattgaagaaaatgaccccttgtgttacaaacatcccccacagctcctcagcaactgccactaaagtgcaccatggaaacaagtcctgcctgagcatacaggacttcagaggtgattttcaaaacacttttgttgtttcagttaccaccacagtctgctcgcagcctcccagaactgcaggtgattcttctccaatgagcattagtaagagtgcagacttgacaagtacagctacagtggtggcatcatctgcccctggagtagggaaggccaccattcctataagcactctttcgggaaaccctttggacaatggttggactctttcttgttctttgccttcttcaagtgttagtacttcagatttgaaaaacattaatagccttacacgaatctcttcagctggaaacacacagacaacgtggactactttgcaactggcaggaaacactattcagcccttaagccagacaccatcttctgctgtgactccagtattaaatgagtctggtactagccccaccacaagcaaccacagtagatatgtggctacagacatcaacttgaataattcctttccagcagatgggcagccagttgagcaagtagttgtaacattgccttcttgtccatctttacctatgcagccactaattgcccagccacaagttaaatctcagcctcccaaaaatatccttccactgaattcagcaatgcaagtgattcagatggctcagccagttgggtcagctgttaattcagctccaactaatcaaaatgttataattcttcagccacctagcaccaccccatgcccaacagtgatgagggcagaagtttccaaccaaacagtaggtcaacagatagtaatcatacaggctgctaatcagaatcctttgccactcctccctgctccacctcctggttctgttcgactccccatcaatggagccaatactgtaatagggtctaataattcagtgcaaaatgttccaacaccacagacttttggaggaaagcatcttgtccacatattaccaagaccttcatctttatcagcgtctaactcaacacaaactttttctgttaccatgtcaaaccaacagcctcaaaccatttctttaaatggacagctctttgctttgcagcctgtgatgtcttcatcaggaactacaaatcaaacccctatgcaaattattcaacccaccaccagcgaagatccaaataccaatgttgccctgaatacatttggtgctttggccagcctcaatcaaagcatatcacagatggctgggcaaagctgtgtacaattgtctattagccagcctgccaattctcaaactgctgcaaatagtcaaaccactacagctaactgtgtttcattaacaacaactgcagcacctcctgtgacaacagatagttcagccacactagctagtacttataatctagtgagtacttcctcaatgaacactgttgcttgtttgcctaacatgaaatctaaaaggttgaataagaagccaggtggcaggaaacacttagcagcaaacaagtcagcgtgtcccctgaattcagtcagagatgtgagcaagttagactgccccaacactgaaggctcagcagagccaccctgtaatgatggactgctagaaagcttccctgctgtgttaccatctgtctctgtgtctcaggcaaatagtgtgagtgtttctgcttcacattctttgggtgttctaagctctgaatcattaatacctgagtctgtatcgaaatctaagtcagcagaaaagtccagcccaccctcccaagaatctgtaacaagtgaacattttgcaatggccgcagcaaaatccaaagattctacccctaatctacaacaagagacatctcaggataaaccaccaagtagtttagcattatcagatgctgccaaaccctgcgcttcagccaatgtattgattccatctccaagtgatcctcacattttggtttctcaggttcctggtttgtcatctacaacaagcactacaagtactgactgtgtttctgaggtagaaatcattgctgaaccttgcagagttgagcaagattcatcagatacaatgcaaaccacaggtctcttaaaggggcaaggtttaactacattgctatctgatcttgctaaaaaaaaaaaccctcagaaatcatctctttctgatcagatggatcatcctgacttttcttcagaaaatcctaaaatagttgattcaagtgtgaatttacatcccaaacaggaactattactgatgaacaatgatgatagagatcctccacagcatcattcctgcctccctgatcaagaggttattaatggttctttgatcaacggtagacaggccgactctcccatgtcaaccagctctggcagtagtcgtagtttctcagttgcatccatgcttcctgaaacaacaagagaagatgtgaccagcaatgcaacaactaatacatgtgacagctgtacctttgtagagcaaactgatatagtagctcttgcagcaagagctatttttgaccaggagaaccttgagaaggggagagttggcctccaggctgatataagggaagttgcttcaaagccttctgaagcatcattgttagagggagacccacccttcaaatcacagatacctaaagagagtggcacaggacaggcagaagcaacaccaaatgaatttaattctcagggttcaattgaagcaactatggagaggccccttgagaaaccaagttgttctctaggaattaaaacatcaaatgcatctttacaggattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgtccctgatgagcagaactccagacaccatttctgaccaaactcaaatgatggtcagtcagatccctcctaattcttcaaactcagttgtgcctgttagcaacccagctcatggagatggccttacacgattatttccacctagtaacaactttgtgactcctgcattgaggcaaactgaagttcagtgtggttctcagccttcagttgctgaacagcagcaaacccaggcaagtcagcatctacaggccctgcagcagcatgttccagctcaaggtgtatctcaccttcatagtaaccatctctacataaagcagcagcagcagcagcagcagcagcagcagcagcaacagcaacaacaacaagcagggcagttaagagagaggcatcacttatatcaaatgcagcatcatgtacctcatgcagagagctctgtccactctcagccccataatgtccaccaacagaggactctgcaacaggaagttcagatgcagaaaaagaggaatcttgttcagggcacccagacctctcagctttccttacaaccaaagcaccatggaactgaccaatcccgatccaagactggccagccacatccccaccatcagcagatgcagcaacaaatgcagcaacactttggaagctcccagacagagaagagctgtgaaaacccttcaactagtcggaaccatcataaccatccccagaaccatctcaatcaagatattatgcaccaacagcaggatgttggaagcagacagcaaggttcaggggtttcatctgaacatgtatctggccataatccaatgcagaggcttttgacatcaagaggcttagagcagcaaatggtgtcccaaccaagtattgtgactagatcttcagacatgacctgtactccacacaggccagagagaaatagagtttcaagttattctgctgaggcactcattggaaagacatcttctaattcagagcagagaatggggatatcaattcagggttccagagtttcagatcagcttgaaatgagaagctatcttgatgttcccagaaataagagtttggctattcataatatgcagggtcgtgtggaccatactgtggcctcagatatccgcctttctgattgtcagacgtttaaaccaagtggagctagtcaacagccccagagtaattttgaagtacaatcttcaagaaacaatgaaataggtaaccctgtatcatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatcttcctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattccacaggttactcagcctagtgccactcgaactccagccctcatcccggtagatccgcaaaatactctgccctccttctatcctccatactctcctgctcatcctacactgtccaatgatatttcaatcccctattttcctaatcagatgttctcaaatcctagcacagagaaggtaaacagtggaagtttaaataaccgatttggatcaattttatctcctcccagacctgttgggtttgctcaaccaagttttcctcttctcccagatatgccaccaatgcacatgaccaactctcacttatccaattttaatatgacatctttgtttccagaaatagccacagcgcttcctgatggctcagcaatgtcacctttgcttacaatagcaaattcctctgcctctgactcttccaagcagtcctcaaacagacctgcccataacataagccatattctaggtcatgattgcagttcagctgtttaaatactgataaacaaaatgtaaaggtaatgagtgagattacaaatgtatttgtgcgtgcatgtgcacagacatgtacatgaagagaaggattgtgtgtgtgtgtctgtataatcagttttcagttatcttctgaatgtagggaagccatgtcagatgcagatactgggttgtcagaaaacaagttatctttcgttttcaactgcatggtgtacttttttattttccaagtagatttacatttccaagttgatatttcctaaatactaattagctggaaattgggggagatcatcttgtcatgtactgggtagtaggagggagcctagactttaaacttgattgttgataacttatggaatatgtaggtaagttgctactgaaaaatataggcagcttgataaaacacagtggctcataatcaagtgctggctaatgtcagcatctagaacagcttcttacctatgacagatgttgaactgatgttgagtttaatgtccgtagttaaagtcaagcagttagcaaataaataaaagcaatcagcctttattctcaaagtttggtttagatacaggcttctttctaaattataacaatgcataaattatctgaattttatgtcttgttcttcaaattagggagctgtgttaccctttaatgtgccaagattatttaaagcaaaggtcttccttagacaattatttagccgtaaatatagaaagctaaaaagttaagtacatacatattctccgttttgtgcttgcattttgcatcgggtcataagggtaaaagcagttagttgtattgtggagttttgcatgggtgcagttaacaatggatgtttcatcagctgagtttaatttagtattctctcttcattctatttatttggtcttgaaataaattcttttgcattcatttaaatattaggattgatcaggaaatagtgtttgtaatctacacgtttatttgagccttactttaaaaatatttctgaacagagatttaagctctgtcagtattttcatttactgatagcatttatattttaaatatggcattgtatatttcattattatccttcataacagaattataatgagaatatgaatttgttatttttcttgttggtagatgtgaaatggtgcttcaaaaaatatatagtctttctgtatgtctctgtgtgtgtaagtatgtgtgtgtgtgtgtacacatattttaaagtatgaattggtcctttaaaaacaggcctgccatctgaaaatgggaaattgagacctgagacctgctaaagcatagaagaacttgatataggtagggttttttttttttttttttttttaatagatggagtctggctctgttgcccaggctggagtgcagtggcgtgatctcagctcactgcaagctccacctcccgggttcaagtgattctcctgcctcagcctcctgtgtagctgggactacaggcacgtgccaccacacctggctaatttttggtacttttagtagagacggggtttcaccgtgttagccaggatggtcttgatctcctgacctcgtgatccacctgcctcggcctcccaaagtgccaggattacaggcatgagccaccgtgcttggcctaggtacaggtttttaaaagccccacagaagtttataatacgtttaaaaacccatattaaaatttgaaaacttaaaaaaaaaa

SEQ ID NO: 198333 - DNA, 2133 bp, Homo sapiens
  Payload ID: 19133
  Gene Name: upstream transcription factor family member 3
  ENST ID: ENST00000491165
  CDS Start-End: 412-678
ggctgggaaagttgaggccgcgctgccgccgggtctccggccttgagggctcgggctcgcagcggctgcggtggccgcaaaaagaggcggcgggggcggggggagaggagggcctgggcccgcgctcccccagccccggaggagcaggcggtggccgcggacggagagattcgcccagacggtcagacactcctgccttcccctcctgggatcatgacccaggcgggggtcgccgccgtcgccgccgccaccgcggccgagaccgcgcagccggcggtaagaagaaagcataacccatagaccatcttctggcagaagatgatacatttggatcagaaacgggaggcattggaagccaggaatcaaaagtgaagaaactctgcaagcccttaggttcctattactgtaaccatgccagaaatgacagagaatgagacgcctacaaaaaagcagcacagaaagaaaaaccgggagacacacaatgcagtggagaggcatagaaagaagaaaattaatgctgggataaacagaataggagagctgatcccatgttctcctgccctgaagcagagcaagaatatgatcctggaccaagcctttaaatatataacagaattgaaaaggcaaaatgatgaactcctgcttaatggaggaaacaatgaacaaggtttctactagaacctgtggaggggggacaccaaatttagattgagtcagtccatgctgataagaagcgtgaggaccttgttggacacagagcttctagatctttccacctgtagcctctaccctgttcctgcactttacctgaaactgtgcctctggtctttagaccagctgttggaacatatcactcacccactcctctgttatagcaaagggccagctgggatggtacacgctgtgtaatcagacaccttctcgacaagtacagctgatgtttctcactgttgccttaccattctctgagccatctttgatgttgatttgtaaaaaaaaacaaaaaacaaaaaaaaaacctagtagcaaaactcctgttaaactcagagcttgtatgtggtggtcattcaacatccttatttctagatttacacaaactgtaccaactgtaatctttttctggcacgcgtatgtggtcagatgcttcataaacgtgagccaacttgggttgtaaacattggacataatatacaaattggggaattttggatgactgcataatcctgtcattagagatttcataagacagaagataactgtttatttgtaatttaacacatttttagaaaagatgatctttaatttctttccctcagttgtgtatacagctatacaccatactaacaccgtactatgtcataggaacttaaagttagatgtatctaaatcccttcacttttctaagacttctctgtgctcccacccctgaagtcttcaaatcatttttcatctgtgaagtcactgaggtactgggcttgactatagtggtaacagttaaggggagttgaactattgatcttccaagaagaaagggaccagatagtgttaagatgctgcagttgtgttactgtgaagaaaagattcgcttccactttcagcaggctatataaatatatatacatatatatatatattttcactttggtaaaaaaaagttgaaaaatctgaggagaacataattaccttcacaaattatttatagatacactgggtgagaagcttactgtagggcagtcacccaaaaaaaactaattttagtgctttcaatagtgtaatatttgtatctattaccatggcagcagtgtctgctgcacactgtgtcctattactgtaaatctcctggtttataattcttatggaaactaatttgttttgtaatggaatccagagcagatatgtataatatgatcaggattgtcctacagttgtaaataagaataggtcctgtttattttgacatctttttacaaatgcattgtattagggtgtgaatattctgaaccatcctcttgtttaaagtttggaaatttttattgttaaatgtaacattttaatggttgtaataattatttgtatagatatgaatatagtattttatttaagaaaataaactttgcatttttgcattgtaaa

SEQ ID NO: 198334 - DNA, 2071 bp, Homo sapiens
  Payload ID: 19134
  Gene Name: uracil DNA glycosylase
  Uniprot ID: P13051
  ENST ID: ENST00000242576
  CDS Start-End: 107-1048
gcatgcgcgggccgcttggcgccaattgctgaccgccacagccacagccagggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 198335 - DNA, 2130 bp, Homo sapiens
  Payload ID: 19134
  Gene Name: uracil DNA glycosylase
  Uniprot ID: P13051
  ENST ID: ENST00000336865
  CDS Start-End: 210-1124
aaaagaccacgtggggacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaata

SEQ ID NO: 198336 - DNA, 2016 bp, Homo sapiens
  Payload ID: 19134
  Gene Name: uracil DNA glycosylase
  ENST ID: ENST00000446767
  CDS Start-End: 177-602
tggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagattttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 198337 - DNA, 2234 bp, Homo sapiens
  Payload ID: 19134
  Gene Name: uracil DNA glycosylase
  ENST ID: ENST00000539287
  CDS Start-End: 180-956
gtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggtagagactgggtttcaccatgttgacaaggctggtcttgaactcctgacctcaagcgatcctcccatcttggtctcccaaagtgctaggattacagatgtaagccaccgcacccgaccagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 198338 - DNA, 725 bp, Homo sapiens
  Payload ID: 19135
  Gene Name: uracil phosphoribosyltransferase (FUR1) homolog (S. cerevisiae)
  ENST ID: ENST00000373373
  CDS Start-End: 129-557
gacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgtgacaactttttttccagtaggagagattacggttatgatttaaaatgaagtgtgtggaatgaagaagatctggagtctggttcatattaaaacatccctgttaacaaataattcagcctagcgttgtgtctaaaatagagcctcagagaatacatgcagcttcattgatacaagacagccagtagaggtgacttcatgttttctgcggatcgtttg

SEQ ID NO: 198339 - DNA, 2234 bp, Homo sapiens
  Payload ID: 19135
  Gene Name: uracil phosphoribosyltransferase (FUR1) homolog (S. cerevisiae)
  ENST ID: ENST00000373379
  CDS Start-End: 166-1011
gtgctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgtgacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgagttcagcatgaggcagtaactagggctccatatagtcctgaggtgggtgccaaatcaatcattcaggagtttccagagatcacaattttaactactgaagttcatcctgttgcacctacacattttggacagaaatactttggaacagactaagttatttaagtaaaataattatcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcagttggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaccatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtg

SEQ ID NO: 198340 - DNA, 2186 bp, Homo sapiens
  Payload ID: 19135
  Gene Name: uracil phosphoribosyltransferase (FUR1) homolog (S. cerevisiae)
  Uniprot ID: Q96BW1
  ENST ID: ENST00000373383
  CDS Start-End: 168-1097
gtgtgctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgtgacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaagttatttaagtaaaataattatcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcagttggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaccatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtg

SEQ ID NO: 198341 - DNA, 1135 bp, Homo sapiens
  Payload ID: 19135
  Gene Name: uracil phosphoribosyltransferase (FUR1) homolog (S. cerevisiae)
  Uniprot ID: Q96BW1
  ENST ID: ENST00000462237
  CDS Start-End: 140-670
aggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgtgacaagacagccagtagaggtgacttcatgttttctgcggatcgtttggttttgcctgaggatttattccaaaagagcatagacaactcctgttctgcttttcatcatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaagttattta

SEQ ID NO: 198342 - DNA, 1636 bp, Homo sapiens
  Payload ID: 19135
  Gene Name: uracil phosphoribosyltransferase (FUR1) homolog (S. cerevisiae)
  ENST ID: ENST00000530743
  CDS Start-End: 54-575
ttcttggccttggcaaactttggagattggggacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaagttatttaagtaaaataattatcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcagttggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaccatgctttttgtaaaaacccctaagatttgtatatgttcatctttaggcttctgaaagggagagaaatcatattggaaatcagtgttggtgttctgaaatctgcttgtaaaactctcatctcatttt

SEQ ID NO: 198343 - DNA, 10832 bp, Homo sapiens
  Payload ID: 19136
  Gene Name: URB1 ribosome biogenesis 1 homolog (S. cerevisiae)
  Uniprot ID: O60287
  ENST ID: ENST00000382751
  CDS Start-End: 117-6932
agccccgcctcttcctgcgccatgtgggcctgaagcgcgtgtctgctgtctgtgccagtgctcctgccgggtcccctcaggtgtgtcgtttccgtcgcgcttccgccctctcggccatgggggtccccaagaggaaggcctcgggcggccaggacggcgcggcttcctccgcgggtgcagccaagcgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcagtgctgactgacctcctccacacccagagggaccccctggctctgtgtctcctgctccaggcatatgataagcttgagcctccatgcctggtgccttgctgccagcagctctcacggtttaacagatactacagcctctggatcccggagcaagcccgagaggcctggctgctgcaggcacagggcagcccctcgccccctgcccttcccttggcctcgtccttcacagccctgctgcaggcagcctacgagagccaagcgcttcgggacgagcacatccaggtgcagctgcaggccaccatgccacacctgtccatgcagcaggtcctgctcgcggccaagcaggtgttgctctacctgcggagcactgtggagaacttcggccagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcccagcaggagtgtcttccgctgtcattcctgtcttgaggaagaccctgtggaggcagctacagagcaggcttcttagcactgacagtcccccagcatctgggctgtaccaggagatcctggcacagctggtcccgtttgcacgagccaaggatctcagtgtactcatggaccgcctgcccagcttgcttcacaccccaagcagtcacaagaggtggatcgtggccgactccatttcagcagctctggaagggtcagcagaagagctgtgtgcctggagaaggacccttttggagtcctgtgtgaagtggctgatcgtgtctttcagtggtggacagcaagatgatgataatactcagaatcaggagaaggaaatgctgcttagattaaatgcgttgttgcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggcgttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaagtttctggagactccgctgctgtctaatgtgatctccttgctacacacactgtgggtgaccaacctgggggacaaggcagtggagtgggagagccagcgcctttgccagcctagctcccaggagcctgccaagcggcttgccctgcacctggtcaatgagttcctttatgttctcatcgtgctcatgaagcacctgaggcccaccttggcccccgtccagctgaccaacttcttcgggacacttgactccgtgctgaggtaccgggccactgtcatacaggcctttagggacatgaacagattcaccgtaaatgagacagtgctttccaccaaggacgtccttgtcctcttgcacaagtggagcctcattgaaagagacctcaagctccaggaagacctgagagcagccattgagaaggcccaagcccgggagctcatgaaaatgctcaaggataagaacaagcctgtcatgccagcccgagccaaaggcccacggggccgaaagaggaggcctggggaggcagaggagatggctgaccctgagctgatggcatctaccttggagacatgcaagggcctcctgaggtccatcttgacttactggagaccagtgatccctggtcctgaccccactcaggagcctgtggactcagccagccccgagagcgatgcgccaggccccgtatatgctgccgcttccctggcagtcagttgggtgctgcggtcggtggccgagcacccgctcagcagggcagaggctgcaggactcattggctggcttaagagccatattttgccacaccctgtggtcgtggctgacctccttaaggacagtgccgtgaggagcagcatattcaggctgtatagccggctctgtggggctgaggggctggcagggcctgtgcaggaggtggcctgcctgttcaatacggtcatgctgcagctggtggctgcccagggccgggcagggagccccttccacccggccatggaagccctctccctgtcttctctgagtgagaaggatgaagccacacaagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttgactcctgccggccagcaccttgcaccctgatgaccagagcctcgagcacagcaccagcttctagaagtttggttgagtcaagggtttccagagaaggcatgggaaacaacaggttcagtacattggctcagttctttgacaagaaaagttgagaggactttattgaactgcccagtaaatgataaactcgggcctgtaggtgcccagcatcagagttgcaaggaatgtggggacttctaggccatgaggcccatccagtgcctcgtcaggccgccccttcctctctaggggcttggagctcatcacaggaaatagctcgagtttgaggcagcacttctgaatgcagaagagattcatctgtgttaaagctgaaatgtcaaaaggtatcagattttttttatgaaaacgaagagagatgtttaaagtttatttttcagcaggtgaggtggctcacgcctataatcccagcactttgggaggccaaggcgggtgaatcacctgaggtcaggagttcgaaaccagccttcccaacatggtgaaaccccatctctactaaaaatacaaaaattagccaggcatggtagcgcacacctgtaattccagctactcgggaggctaaggcaggggaatcgcttgaacctgggaggtggaggctacagtgagctgagatcgtgccattgcgctccagcctaggtgacagagcaagactccatctcaaaaaaataaaaaaataaagtttgtttttctataaaaagtcataacaaagtattagtatgactttttgaataagttaatttctgccagtgtttaattattttattaaagaaaaggatgttacactgaatccttaaagaataaaagtgatttgacctctgctttgagaagacagcctgtaatttttaaagctatacttcaaagaggggattttgaattttataaatgcttgttaatgtctatttttgtaaggtttttgtgttttcctttcattgttgtcaagaggctatttttgctccacataggcctgcatttattttaaaggtcagaattttactcttaatggtcatatattagttggggttgtagctgacaaaagtcatgaaatttcgtggttttcacagttaaaatttccgtctgttcctttaaaactctcctgcatgcctggggctcttgggatctgctctgtggcctaggatgtggctgttttatctgccgtataatgtacatcgtgctgacaatgccttggttttgtctgaaacatttacacttctattttccaccagtgttctttagaattgtttctgttttaggtgacttaaagttttaactaaagcatgagtaacgtttgttggcatacagtcccttcaccacaaataattgtcttgcactgtctacaaagcaaggatcagttacctcacttgtccccttccctacccaaataaaccttacaacgctattctttgagactatcctgaacttgaaatcccacgtttagatccaagctggactcaggcaagcgctgctccaacaaagcgttctcttcctggttccccttaatctttatccacctctccaaggcctatctttggggattcctttggttataggcacctctgcttgtttatgcagggggcattggccggaaggacattggtctggggaatatccctgaaccccatgcctctgggggcacagggaggggcagcgagcaggtggggtggatttccacggcttcatccctggctccaggcctaagctgcctcccaggttcttagggcccagcaagtcaatacatactacgtcaggtggcgacaaatgctccaaagccgagttccagctcagtcaagtgaggacacattttcagcacctcaccttcttttctgcatctctggagctcatcagtcttgcttttctttgttctcccttttaaatccactgccctgaccttgttcgtgtattttccagtcacttagtgtggaggaagggaatctcatcccatggagaatagatcgaacatggtcttcacctgacttaaaatataaaatgctaaattagaaatatcttaagtggggcggggggcacagttattttaaaaataaaacctatcaactccctccttgcctgaaagctgtaggggacatatgggtcttctgagatttgctgtgtgatgctgtctcctctccagggacaaggctgctgggcactagaggactagatctttcaagggtcccagatccactgtcacataaagtcacatccagaagacctttcctgccagcttccagggctctttgtgttctgtgacagcatttgggcatagatcctgcttacccggcctggctgctgacaggcgttggctgcctgccctccaggggagacactttcttgggctctgtctttgaaaggctgtggggaggttgaaggtgcaactcaggtccccagactgcagtgagctgacctggcagggcagatgccatcacatctgggggagccggcgggtgttagtggagcttggatgggaacttacccagcatcctaacaaaggtacagaaggaccaggtgaactcagggctgataacgcattacacagtaatggtaaagtggcatagtaaagattagtaagcaaacagcttttcctcttgatttgcatatattttattttcctactcttccctgagcaaatataagcagtaagcaagcaggctaggtgtgctcaataaactcagcaacacctgggatgacctctgcactcgaggggccactgcaatctttgtcaaaggcataggatgctcctgctctagttgcacttgacctaggtgccctttctgctacatgcaaatggcctctaagaagaacgaggaacgtatgtgtccaggttggcttgatttcaccagttcactcagctatggccacgatttactgacatcagctctgcaattgagaggtcctgtctccagggggaggctcgctgggcttgctcctgacgaggggacccccattgagggtcagttcccagaggagagtggggtgggtctggaaacccccgaggggcaaggtggaggagctctcctgtcgtagcggctggtcagggccagttctgctccctggctccactgagctcgcctgagcctgtgaggttgccaggggttccctgtggcacggcaggcacttctggatgcagaggtggaggttgaggccgtgactccaggggcatgtttggtggtgcttggggctgttcctgtgaacagagcagagtgggaggcaggcatcatagttgctgcagaacagtccatactgtggggctggggggtttcctgccacacctgccatctgcccggaccccatagggaaggccacacaggcaaattcctgagaagggtcagccagctcacaaaggtggccattctagagaaatctcagaggagaggaagtgctttgtcaggaactaggcctcaggtctttccctggaggccacttcttcctacattgatttaggatggggggggtggggggtggaggggagcaggttgacctcccatccagcgctgtatctgagtgtagttcattttatatccatagcccaagccaacttgtatcttggtgatatggtttggctgcgtcacgacacaaatctcaccttgaattgtaataatccccacgtgtcgtgggaaggacccagtgggaggtaattgaatcatgggggcgggtcttcccatgctgttctcgtgatagtaagtctcatgagatctgatggttttataaaggggagtttccctgcacatgcccttttgcctgtgtcatgtaagatgtggctttgctcttcctttgccttctgccatgactgtgaagcctcccccgccatgtgaaactgtgagtccattaaacctctttcctttataaatta

SEQ ID NO: 198344 - DNA, 5613 bp, Homo sapiens
  Payload ID: 19137
  Gene Name: URB2 ribosome biogenesis 2 homolog (S. cerevisiae)
  Uniprot ID: Q14146
  ENST ID: ENST00000258243
  CDS Start-End: 137-4711
ggacgcgggacccgtacagcggcctccgccgcaccgggacagcagccgccgccgctgccgccgtcctcccctgtctacccggagctgtctcgagctgagccccctaccgggccggatcccgagataaagcctagccatggctgctgtttattctggcatttcccttaagcttaaaagcaagacaacttcctgggaagataaactaaaactagctcactttgcttggatttctcaccagtgctttcttccaaataaagaacaagtgttacttgattgggcaagacaatcattggttgcattttataagaaaaagcttgaactgaaggaagatattgttgaaaggctttggatctatatagataacattttacatagcagaaaattgcagaatctcctcaagaatggaaagaccattaatcttcagatttccctagtcaagatcatcaatgagagagtagctgagttctctctttcgggatcccaaagaaacatctgtgctgtccttcgatgttgccagggcatcctgtcgacacctgccctggctgtcatctacacggccaaacaggagctgatggtggccttgctgagccagctttgctggtcggcctgcaggcagcccgaaggagctgtggtagcccagttgtttgaggtcattcacctggcccttggccattatctcttgatcctgcagcagcaggtcaacccaagacgtgcctttggggatgtgactgctcacctgctccagccgtgcctggtcctgaggcacttactctctgggggcacatggacgcaggctggccagggccagctgaggcaggtgctgagccgggacatcaggagtcagattgaggccatgttccgaggagggatttttcagcctgagctactgtcatcctacaaggaggggctcttggaccagcagcaaggggatgtgaagacgggagccatgaagaaccttctggctcccatggacaccgtgcttaacaggctggttgatgctggctactgtgcagcatcccttcatacctctgttgtggccaactcagtggccttgctgtataagctctttctagattcttactttaaggagggaaaccagcttctctgcttccaggttctccccaggttgtttggctgcttgaagatttcacacctgcaggaggagcagagcaaagccctgtccacatcagattggaccacagagcttttggttgtggaacagctactaaactcagtggccaacaacaatatctacaacatcgctgccgacagaattcggcacgaagaggctcagttccgcttttaccgccacgtggctgagctgctgataaaccatgcacaagcacccataccggcctggttccgctgtctgaagactttgatatctctgaatcatttgattttggagccagacctggatgacctgctggcttcagcgtggatcgatgccgaggtaacagagtttcgaaccaaaaaagcccaggaggcgcttattcgtactgtcttccagacttatgccaaactccgacaagtgccacggttgtttgaagaggttttgggggtgatctgtcgtccagctgctgaggcactgaggcagcctgtgctggcctcgggcccctccacggtactctctgcatgcctcctggagctgcctccaagtcagatcctggacacgtggtcccttgtgctggagaagttccagtctttagtcttgccctatttgcagagtgatgccgacatggccctgaaatcactgtcactgagcttgctgctgcactgcatcatgttcaacatgaggagcctggacagcagcacgcctctgcccattgtcagacggacacagtgcatgatggagaggatgatgagggagctcgtgcagcccctgctggcccttctcccggacaccccaggcccagagccagagctgtggctgcagaaggtcagtgactctgtgctcctgctctcttacacttgggcccaggtggacgctatgttcagtttgaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagcttggtgctcaattttagaaaaatcaccgcattcctctctagttccaaaccatacacggaggcagcttcaagcaaacaattagaaaatcagaacccccagggcaggcagctccttctggtgtctttaaccaggttgtgccatgtcctgggacctttcctcaaagagcagaagctgggccaagaggccccagcagcactgtctgagctgctgcagcaggttgtgctgcagacaggagctgtgctgcagctctgctcagtgccgggggcccggggctggcgccttccctcggtcctcatctcatccgtcagcacgctcttggaagccgacctgggtcagcactgcagggatggaggggccgacatttcccaaggaagcgacaggacgctgctctcccatgttgccctctaccagggtgtttactctcagatactgttggagttgccagctctcgcgggacatgatcagtcttttcaggcagccttgcagtttttgactctgttctttttggccccagaactgcatcccaaaaaggactccgtgtttacctccatgtttcattctgtgagaagagttcttgcagatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggctgttgtgtcagctgttacactgctgaggctgctactgaactgcccactcagtggagagaaagcaagtctgttgtggcgtgcgtgtccccagatagtcacagctttaacactcttaaaccgagaagcttctcaggagcagcctgtgtccctcacagtggtcgggcctgtcttagatgtcctggctgcactgctgcggcagggggaggaggccatcggcaacccccaccacgtcagcctggccttcagcatccttctcactgtccctttggaccatctgaagccgctggagtatggaagcgtcttcccgaggctgcacaacgtgctcttctcaatcctgcagtgtcaccctaaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaagaatgtacagccacatcgccgcacgagctgaggagtttgctgtgttttccccatttatggtggcccagtacgtgttggaggtacagaaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtgcatataaatatatatagtagctaaattggatcataaatgcatttttttaaagtt

SEQ ID NO: 198345 - DNA, 643 bp, Homo sapiens
  Payload ID: 19137
  Gene Name: URB2 ribosome biogenesis 2 homolog (S. cerevisiae)
  ENST ID: ENST00000434387
  CDS Start-End: 392-643
ccaatgatacttgaatatattaattagtactgttcctattattgtttgtttctacccatttccagaatggattagcaccagcttagagtaaaaggtacagactcagcaaattccaaaccaggattgccccatagacctcctgaagttacgcagtgtgggttctctaccctagatagttaaaacaagggtcaaagagtctaatacaagatgggtgagcagtgacagcagcatgtccaggcgaaaggatgtggctatccctgggcacacacaactggtttgagtgtcccgatagactaggctaagaaagaaataagtatgagctcctttaaagtagaaaaacttaaataatcacgtatgtacttttacattctgttatctgtcattacaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaagaatgtacagccacatcgccgcacgagctgaggagtttgctgtgttttccccatttatggtggcccagtacgtgttggaggtacagaaggtgaccttatatccagctgtgaaaagt

SEQ ID NO: 198346 - DNA, 931 bp, Homo sapiens
  Payload ID: 19138
  Gene Name: ureidoimidazoline (2-oxo-4-hydroxy-4-carboxy-5-) decarboxylase
  Uniprot ID: A6NGE7
  ENST ID: ENST00000332715
  CDS Start-End: 18-539
ccagtggaatacaaggaatggacattgagaaggtcaactccatggaccttggagaattcgtggatgtgtttgggaatgccactgagagatgtcctctgattgcagctgctgtttggtcccagcggccattctctgatttggaagatttagagaagcacttttttgcctttattgatgcccttgcacagtcaggccaggagggcatcctgcgctgccacccggacctggcgggcagcgagctgcagcggggcacgctcacggccgagtcgcagcgggaacagagcggcgcaggcctgaggagcctgggcgcggacgagcggctgcggctggccgagctcaacgcgcagtaccgcgcgcgcttcggtttccccttcgtgctcgccgcgcgcttcagcgaccggacggcggtgccgcgcgagctggcgcgccggctgctctgcccgtccgcgcaggagctgcgcactgctctgggcgaggtgaagaagatcggcagcctgcgcctggccgacctcctccgcgcagaccccgccaagctgtagctgccgcgcgggccagggacccgggacgcacaaccggacgcgcgggggccacggcccggagctgtgcgtcctgggcgggaggcggactcgggcctggaacagcgtccacacacgtgcacaaaggaagtggagaattgaggcaatcatacgagtaatgagtccttttgtccgcccacccacacgcgcacgcgttgccaaaatatccatattgtttagtgctttgccccggatttatccagctcactgcttcaattcttcactccctttgcggcccccgacaccaccggcctttgtggattccaaagcgtttatccagttctccccaaccctctcctgctaagcccgaactgcaaagcaaaacggacggaaaaggaatcttttatgccacagcg

SEQ ID NO: 198347 - DNA, 2290 bp, Homo sapiens
  Payload ID: 19139
  Gene Name: ureidopropionase, beta
  Uniprot ID: Q9UBR1
  ENST ID: ENST00000326010
  CDS Start-End: 345-1499
aaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgaccgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 198348 - DNA, 1928 bp, Homo sapiens
  Payload ID: 19139
  Gene Name: ureidopropionase, beta
  ENST ID: ENST00000382760
  CDS Start-End: 163-723
ggattggctgcgcgaggaagtggcgtgtcctcacttgagctgtctgggagcgagagtaagagataaaggcaagggcgcctgaccgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggattctccgtccacatcaccaggaaccccggcctccctgctgttacgcaccgagctgttgtctgattccttcagttttcccacatcgttctgaatccattcgctcctctccatctctctaccaccacctggtccaagcccctggcagctcacctctggcttttgtaattccctccagctggtctcctgtgccctcctgaccaggacttctttaccttcagatctcagcccagagccagcccccccatctaaacatcctggtagtatgtacctttgtggtttttatttttatcagagttttacatgctcatggtttagagtcagatgggtgtacaaggtctgttaccaaaaaatagctattatccccagcatcaacactgagctagttcctttggaatttacctttgttagtgttgctacttcctaattttttagttttgcatcacctattgacttccccctatggaagatgtcagtgttagccctttcttgcctcctcctggcccttcgacatacatgtgtccttgttctatccccccagcccattttgtcaactttgattccttttctttttttttaagacaaggacttactctgtcacccaggcttagagtacaatcacagctcactgcagccttgatcccaggcccaagcaatcctcccacctcagcctcccaagtagctgggaccacaggtgcacaccatcacgcccagctaattgaaaaaaaaaagtttgtagagatggagatctcactatattgctaggctgaactttgatttcttttcctgaattattttctgttttccctagagtttgctttgttttctacttgccacgcattcaaccccaaactttctatcaattcctaaatctcccttaatgtgttttagacgcatcaaacagtctatcagtttcatctcctccaaggaatctgccccagagccttgtgactgctgtggtctgaatcaggtgccccctctgctggccacacagttattgtcctgggatcccccctcatcatcaccctggggaatccctttgccttgctcttgtgtttctctgttcccacagcttcctctttcttggtttatacccttattttagtggagtggtgtagtggatccttatagatttatgttgcctcggcatccatgttgaatacaagtttaactctctcataccagcggcagggctcggtcacgctggacacagtttccagatctacaccacaccgagatggctcaagccaagtggccagaggtaagaacttaagaggcctctctcccaccagcagactgggctgcccactttcctgctgcttcctttaaatggaccatccaggcatttggccattaacttaaggtgaccacatcttagtcattatgtgtactgctagttgcccca

SEQ ID NO: 198349 - DNA, 3154 bp, Homo sapiens
  Payload ID: 19139
  Gene Name: ureidopropionase, beta
  ENST ID: ENST00000415388
  CDS Start-End: 1298-1426
agataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctctggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgaccgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatcccctactggttctgcttctctagttgaatctgactgatacagattttggtgccaaaagtggttctagaaaaatagaatcttaaagatg

SEQ ID NO: 198350 - DNA, 795 bp, Homo sapiens
  Payload ID: 19140
  Gene Name: URGCP-MRPS24 readthrough
  ENST ID: ENST00000603700
  CDS Start-End: 15-347
acctcgctgcgctcatggcgtcgcccgggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacaggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 198351 - DNA, 1579 bp, Homo sapiens
  Payload ID: 19141
  Gene Name: URI1, prefoldin-like chaperone
  Uniprot ID: O94763
  ENST ID: ENST00000360605
  CDS Start-End: 49-1476
agtgggtcttctcactcttttccaggctccttggaggtcactgccctgatgacaacatggtcttcccttcaaggaagccacgtttctaagagggctctggcatatgcattggtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaa

SEQ ID NO: 198352 - DNA, 3444 bp, Homo sapiens
  Payload ID: 19141
  Gene Name: URI1, prefoldin-like chaperone
  Uniprot ID: O94763
  ENST ID: ENST00000392271
  CDS Start-End: 298-1905
gcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctcaaaaatgttgtgaactttatgattcaaaattgagtacagatatgtccttgattcatatgtatgctacatgtatcacacaacagatctggaattctttcagttcctcagatacttctcccttagtttttgcagtttcactgggattatgttttgggaaacaaggaaaggtctagatgcttaaacattttaaataaaaattccttacagtttcatcttcccaacattttcattctttaaggctactttcctactaactgaaataacacatttacttttaccacaattcctcaaaataaatttattctaacattgaaaataacattacaagttaatcattagcttgatgcatgctaaaatgtagcttttaaaaagcattctgcattagtactaaaataagccatcaatgccagtccaccctctctattcatggctaaatatttaaaggttatttatagcttctttaatgaattcttcttaaacaaagtgaaattatgtcctagaaaagtagaagctattcgtaactagagcagtgcaactttaaagttttatgaatatgtattttaatgacaagggggcgagcttgcatccccactagttaatggataattcaaaccgaggactgattttgaaagatcacctaaaaatgtagatttgttctttagtaaatttagatcaactatgcatatattttgtaggtaaatctttcagtccatgccccaaccctcaccaaaaccaaagcagaaattacacacacaaagatgctcccgttaggaattgctattcacatgaggctttctgtgctagatttttttctcagaaacaaactttactgtaggactattgtggtgttcttaacagatttgtaatttcaagatgcgtgtcattaaataatttttcatgttca

SEQ ID NO: 198353 - DNA, 291 bp, Homo sapiens
  Payload ID: 19141
  Gene Name: URI1, prefoldin-like chaperone
  ENST ID: ENST00000573052
  CDS Start-End: 1-121
gagtatcagctgcgaagaagccacttgcagtgacaccagtgagagcattttggaagaggaaccacaagaaaatcaaaagaaacttttgcccttatcagtaacacctgagttgaacatatagttgaccagattaaatgcagcaaacatccaggctttttctggaactgttatagaaaaagaatttgtatcaccttccttaacaccacccccagccattgctcatcccgcactacccactattccagaacgaaaggaagttctgttggaagcatctgaagaaactggaaagag

SEQ ID NO: 198354 - DNA, 486 bp, Homo sapiens
  Payload ID: 19141
  Gene Name: URI1, prefoldin-like chaperone
  ENST ID: ENST00000574233
  CDS Start-End: 272-486
gatgacaacatggtcttcccttcaaggaagccacgtttctaagagggctctggcatatgcattgagatgagtttgctgtgttggccagactagtctccaactccaggcctcaagtgatccacccgcctctgcttcccaaagtgctgggaccacaacaagtgtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagattt

SEQ ID NO: 198355 - DNA, 844 bp, Homo sapiens
  Payload ID: 19141
  Gene Name: URI1, prefoldin-like chaperone
  ENST ID: ENST00000574666
  CDS Start-End: 238-390
gcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggtggtcactaactgccaagagagaatccagcattgaggtgaaaagccaggcatccttcaagctagtggatctttgacaaagatgcattgcaaaacaatcaacaaacaatcagaaaggcatgctatgtgaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaa

SEQ ID NO: 198356 - DNA, 1032 bp, Homo sapiens
  Payload ID: 19141
  Gene Name: URI1, prefoldin-like chaperone
  ENST ID: ENST00000575242
  CDS Start-End: 1-685
tgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggtgtgtgtgtgtatcttttaattctttatttcatatagtatctttgaccagttttagctatttaatctgaaaagtcataagattaaattaattctaggttttatactttcttggtactaattaataaaaaattaatagtcacaaacagtacaaatattgtgataatcaaatagtttattttttgataaacacattacttgtcttaacgttctatttcagcaaaatgggaaatttaaaatgtcttacttggcattatgtattacatttgtagctaggaaattatttcgcagtttattttaaataaattaccagtaggtcattttctgatagtgtaaggagcagattacattattctcttttaaatacct

SEQ ID NO: 198357 - DNA, 514 bp, Homo sapiens
  Payload ID: 19141
  Gene Name: URI1, prefoldin-like chaperone
  ENST ID: ENST00000570564
  CDS Start-End: 416-514
actcttttccaggctccttggaggtcactgccctgatgacaacatggtcttcccttcaaggaagccacgtttctaagagggctctggcatatgcattggtggtcactaactgccaagagagaatccagcattgaggtgaaaagccaggcatccttcaagctagtggatctttgacaaagatgcattgcaaaacaatcaacaaacaatcagaaaggcatgctatgtgtgagtgatgatccctgcagcatatgccataggcttgttgtagaggagctgctcagtaaatggtggattcaattgaaacaagtcttttttggatgcttaatgggaagttgtagggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctca

SEQ ID NO: 198358 - DNA, 2495 bp, Homo sapiens
  Payload ID: 19141
  Gene Name: URI1, prefoldin-like chaperone
  ENST ID: ENST00000574110
  CDS Start-End: 288-419
cgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctc

SEQ ID NO: 198359 - DNA, 578 bp, Homo sapiens
  Payload ID: 19141
  Gene Name: URI1, prefoldin-like chaperone
  ENST ID: ENST00000576442
  CDS Start-End: 212-578
aaatctgtaaagccaatgttctagttttcagatacactgatttttgtagctctgtgcatagctctgttttttcatgagtagttatctgttttcatgacaggtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatg

SEQ ID NO: 198360 - DNA, 385 bp, Homo sapiens
  Payload ID: 19141
  Gene Name: URI1, prefoldin-like chaperone
  ENST ID: ENST00000585655
  CDS Start-End: 1-54
agggctctggcatatgcattgggcctctgtgaggttttaatgaatgaaggctgaagaaactccacagagatggtgactttcccccagcacagctcttgccctcaaggaagagacactcgaccaaacaggcaactggaaacaggatggcttcgtgggcgtgtgtgacttacacagggctgtgcactcagaagaatcccgtgactgacttaggctctgcagctgccatcttgaaattcttaataacttttgaatggtgttgggggtggggttggaggggatggtccacactttcattttgcactgggcactacaaattatgtgaccggctctgattaaaatgctacaagaactaacatgaaactggacacagaaaccagaccccaga

SEQ ID NO: 198361 - DNA, 6738 bp, Homo sapiens
  Payload ID: 19142
  Gene Name: uridine monophosphate synthetase
  Uniprot ID: P11172
  ENST ID: ENST00000232607
  CDS Start-End: 107-1549
ctgcagacgaggcaggcggaagaggcgggacttcgcgggtgacgtcatcggggcgccggaggcccggggcgcctgggaatttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaaggtggtgtttgagcaggggcagggtgagggctgtcccggtgctcattgcaccagcacactcacattccttctcatttggggcccacctgcaggaagtggcacaggatcagccatttccccacccttgtcagctgatggcccactgttctttaatgactcagaggaatgcctaggatttttttttttttttgagacagaatctcactgtcgcccaggctggagttcagtggcacgatctcggctcactgcaacttctgcctctctggttcaagcagttctcctgcctcagcctcccgagtagctgggactacaagcctaggatttttaactcaggtttttattatattccctcctgaagtttttacttcaagagcttctgctctaaagtccaatttgggcttcatgtccccagtgctgcatctccagggaaatgctgtctgtgggagagaccaactctcaaggaagaagtggccacagaaggagcaggaagggagttggccctcagggctactctggggaagccaaaagtcatgaaggggagaagaattttctgacaaaaacttgcaggaatctcttaggtgtcttcagtgttggagtgatatgttgagaggcctttggagtgatgtgctgaggtctcaggcgcccacctccctggctgtcacttccatgtgtcagtggttctcccactttagcaggtatcagagtcacctggagtcttgtcaaaacaggtaccagccccacccgcagcgtttctgactctgggtagctctgggatggggcttgagaatttgcgtttccaaaaaggtcccaggtgatgctgcggttgcctgcgcagggactggactttgagaaccacttcactggttattcacatttctgcctctgcagtgagacagccttgaggtctgcctcctgctaagagtcacatgctcctgtcctttagaaatgtgggctcctgccatctccaggacgcaggcactgttcctgttgatgaaccctatttcacaggacccctgctaaggtgatttgaggggaaatgagaggaggctcaaataatcacccagcccctgccacttactgaaagtgtaggtccttgtgccccacaccatcagagtttctgcgttagcagatttgtggtttgcccagcagcctgggcgtgtgcatttctaatgggtgcctcaagtgatctgtttctgatttgtatttctattgtgaagagtcagcccagtactgcaggcctcttacctaagcagaatcccagtctggcatcaaagctttagaggacaagttgattcaggcagagaagaacttgggctatacaagcgctgttcttcagcattgaagtattttggaggcattagatagtttaaccctttctcagtcaaggaatatttacagaacatgatctctgggcattgtaactcctggtcttagtggggaatatagggaccccatgtctccatggggtgcacagaatgtctgtgagactgatggagtggagaacgccatcccccagcctctccagctactcgaggcattctgtagaacataagcccatagattgtgtgtgtgtgtgtgtgtgtgtgtgtgtgtgtgtgtgtgtgcatgcgcgcgcgtgcgcactggaggaacctaagaaactatttggtgcacttcctcttattttagagctcccaaagtgtagctccagaatcgtaaagggatatgctcagtctcacagccagcctgtggatctcagtcccaacactcacccttgtgctactgagtcagctctaagaaaatctgccaaaagtaggccgagggctggttttttgttttgttttgtttgtttgatacagggtcttcactctgttgcccaggctggagtatatcatggctcactgcaaccttgacttgggctcaagcgatccgctcaagtagctggaactactctcaagtagctctcaagagcctctcgagtggctggaactacaggcgtgcaccaccacagctggttaatttttaaaattttttgtagagacggtggaggaggttctcactgtgactcagtgtgtgcccgacagcagagcccacaccactccagttgcagtggttgccatctgggtcatcagacctggctgtcaggggtgcagccacaggagagccaacagcagagggtgctggccgctgagctagctgctaatgctggcctgggtgcagttctcatccaaagtacccggtgggtgggagtcactcagtaccagttccgagcctgaacccaaactctcgtgtttctgctcacccctctctggcttctgccaccacatgggaagaatatgccctggttagcccatggcttctgaagagcaagagaaagtagagcagagcctactccagcctcccccgtccaatgtatgaaagccccagctgatctgtaagcctgggagcgtgataaatgcttagtagtgcatgccatggagttccagggtggtttattacacggcaatatctagctaaatacatttaacttgctgcagctctctggatccagcctggttaccaggaagacaaaaactgggctccaccaggaaccagtcttctgccttcccaaccatcacctctggctgcatcagcgatctctcccagcgaaatagctgcttggtcttgtgtgaatcctgtactttaacacagtggaccaagtgtcagtcattgaaaatgaccatgagtaaccctgtggactctctgcagcttggttcctttgccccttaacaggtgggtatgaatcgtgtcttcagtgccagggctgaatgagaaagggcattcctttttgaaggaatctgatactaaacacaaagcatgagaaaaatcaggacttgttggagttatatttttaaaatatatattttaacagttatatatattagatataatatataatagtatatataaataatactatattgcccaggctggtctcgaactccttagctcaagtgatcctcctgccttggcttcccaaagtgctaggattacaggtgtgagccactgctcccggcctgttggagttctttacatttattttataatcaatgctgttttattaaatgcggattttattttggattacaggatgtagaatgccatatttttcttagatcatagggcctttcacatttgtaatttggccttgtatgagttaccctgcaatccctttgttttccccataacccttccaaaggaaggccgcaatagaaatacaaagagaaacaaaataattagaatattttttaacttctaaagttcaaggttttggcataagtctggtttagaagcacatttgcctagccctttccttcccaccaagggggaaagtcttcctctagacaagaggcagagggctcctcagagtcagatcctggtgtgggctctcacgtgctgctgctgaatcccagggaaggagggaggaagggcagttgacacccaaaataagggtggggaactgtcagcagaggaggtctgtgtcatgtttttcagcgctggggttggggggagcccaggagagcaggaagatccagagatccctcgccccagctcggccatgtgtgtctgggacagagcctgaggtggcctgagcttcctgtggctccagagtaacattatagagaagctgaattctcctgtttttctgaaaagggcatgggagttagctgagaagcagacctggtgggcctgagagtctcaatcgtcaggtaaggacagtcagtgggaagtggacgggccgcacaaccaaggttctcatgaggacaaccatgtcttcgggggtgcccttgtgcacagacagctccatagtcctgcctccaatgtcccaacactgcattgtctccctgcacttagcagccctgcagggtgagacttggggaggatcctgaaatgattgtatttaacaagacatgctgtccttgtttacctggaacctagcaatgttgttttctgccacaacttgaatagatacttgaagcagagatgatgttgagttaaaaaaaatatatacataaaaatatgggttcttttcaacctgaatagatggcctaaaaattcaaa

SEQ ID NO: 198362 - DNA, 2001 bp, Homo sapiens
  Payload ID: 19142
  Gene Name: uridine monophosphate synthetase
  ENST ID: ENST00000462091
  CDS Start-End: 40-213
ggcgcctgggaatttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagc

SEQ ID NO: 198363 - DNA, 1691 bp, Homo sapiens
  Payload ID: 19142
  Gene Name: uridine monophosphate synthetase
  ENST ID: ENST00000497791
  CDS Start-End: 21-194
caaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagc

SEQ ID NO: 198364 - DNA, 2242 bp, Homo sapiens
  Payload ID: 19142
  Gene Name: uridine monophosphate synthetase
  ENST ID: ENST00000467167
  CDS Start-End: 28-228
tttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcagatgggatctctcttacgtcacccaggctggagtgcagctctgtgatcatagctcactgcagcctggaactcctgggcttaagagatcttcttgcctcgggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagc

SEQ ID NO: 198365 - DNA, 1789 bp, Homo sapiens
  Payload ID: 19142
  Gene Name: uridine monophosphate synthetase
  ENST ID: ENST00000474588
  CDS Start-End: 21-449
caaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagc

SEQ ID NO: 198366 - DNA, 2081 bp, Homo sapiens
  Payload ID: 19142
  Gene Name: uridine monophosphate synthetase
  ENST ID: ENST00000460034
  CDS Start-End: 21-221
caaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcagatgggatctctcttacgtcacccaggctggagtgcagctctgtgatcatagctcactgcagcctggaactcctgggcttaagagatcttcttgcctcgggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagc

SEQ ID NO: 198367 - DNA, 2340 bp, Homo sapiens
  Payload ID: 19142
  Gene Name: uridine monophosphate synthetase
  ENST ID: ENST00000479719
  CDS Start-End: 21-1049
caaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggtaagtgtattattcaggaatctgcaagaatcagaaatccagcttaaactgaagaagaaaaaggaaatgctcatgtcattgaaagtccattcatagagcaggctgtcaagcgtggttggatccaggagctcaagtgatatcttcatgacttgctttctctccatctctcagctctgctttcttctctgttgacttctttctcaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagc

SEQ ID NO: 198368 - DNA, 228 bp, Homo sapiens
  Payload ID: 19142
  Gene Name: uridine monophosphate synthetase
  ENST ID: ENST00000628619
  CDS Start-End: 28-228
tttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcagatgggatctctcttacgtcacccaggctggagtgcagctctgtga

SEQ ID NO: 198369 - DNA, 1932 bp, Homo sapiens
  Payload ID: 19143
  Gene Name: uridine phosphorylase 1
  Uniprot ID: Q16831
  ENST ID: ENST00000331803
  CDS Start-End: 624-1556
gcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtggggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgca

SEQ ID NO: 198370 - DNA, 955 bp, Homo sapiens
  Payload ID: 19143
  Gene Name: uridine phosphorylase 1
  Uniprot ID: Q16831
  ENST ID: ENST00000395560
  CDS Start-End: 353-463
attcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaa

SEQ ID NO: 198371 - DNA, 1375 bp, Homo sapiens
  Payload ID: 19143
  Gene Name: uridine phosphorylase 1
  Uniprot ID: Q16831
  ENST ID: ENST00000395564
  CDS Start-End: 381-1313
tgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaa

SEQ ID NO: 198372 - DNA, 682 bp, Homo sapiens
  Payload ID: 19143
  Gene Name: uridine phosphorylase 1
  ENST ID: ENST00000432131
  CDS Start-End: 594-682
caggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaa

SEQ ID NO: 198373 - DNA, 918 bp, Homo sapiens
  Payload ID: 19143
  Gene Name: uridine phosphorylase 1
  ENST ID: ENST00000436673
  CDS Start-End: 481-918
attcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtggggcggtgacggaggctctggtgcaccttggctgtgagctgcagaggagcagagagcggcccggcgcggctgcgcggggaggcgggcgcgcggccgggaggttctggggctggtgtgtgcggagcgagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggt

SEQ ID NO: 198374 - DNA, 869 bp, Homo sapiens
  Payload ID: 19143
  Gene Name: uridine phosphorylase 1
  ENST ID: ENST00000444999
  CDS Start-End: 336-593
cacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcagcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaag

SEQ ID NO: 198375 - DNA, 864 bp, Homo sapiens
  Payload ID: 19143
  Gene Name: uridine phosphorylase 1
  ENST ID: ENST00000416681
  CDS Start-End: 433-864
ggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtggggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtggg

SEQ ID NO: 198376 - DNA, 1013 bp, Homo sapiens
  Payload ID: 19143
  Gene Name: uridine phosphorylase 1
  Uniprot ID: Q16831
  ENST ID: ENST00000457596
  CDS Start-End: 528-638
acagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagca

SEQ ID NO: 198377 - DNA, 782 bp, Homo sapiens
  Payload ID: 19143
  Gene Name: uridine phosphorylase 1
  Uniprot ID: Q16831
  ENST ID: ENST00000417464
  CDS Start-End: 180-290
ggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaa

SEQ ID NO: 198378 - DNA, 974 bp, Homo sapiens
  Payload ID: 19143
  Gene Name: uridine phosphorylase 1
  ENST ID: ENST00000421046
  CDS Start-End: 329-844
agactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggattttgaagcaccttaggagaaaagacacaggaaaatcaaaggggggaagagagaggcgcagtacaaaactcagataagtgtccttaaattagcttaaaatgtccctatcctcaacagggacattttttttttgtttaaaaaacaaagatggttggccgggcgcggtggctcacacctgtaatcccagcacattgggaggccgaggcg

SEQ ID NO: 198379 - DNA, 2224 bp, Homo sapiens
  Payload ID: 19144
  Gene Name: uridine phosphorylase 2
  Uniprot ID: O95045
  ENST ID: ENST00000005756
  CDS Start-End: 195-1148
tatttgataggaaaatttaaaatgctaaaggaaaaattttcttagcaatttcacaggaaaacctaagttttaagagaggttatcattctgactgggaactgaactattatgactaggtctataatttaataacaagtcacaatatctctctttcttgacatcaatttaaggtgacttttcacatagtagagagaatggcttcagttatacctgcctccaataggtccatgagatctgacaggaatacatatgttggaaaaaggtttgttcacgttaaaaatccttacttggatttgatggatgaagacattctctatcacttggatttgggaacaaaaacacacaacctaccagcaatgtttggagatgtaaagtttgtctgtgtcggtgggagccccaacagaatgaaagcatttgcactgtttatgcacaaggagctcgggtttgaggaagctgaagaagacataaaagacatctgtgctgggacagacagatactgtatgtacaaaaccgggcctgtgctcgccatcagtcacggcatgggcatcccctccatttctattatgcttcatgaactcatcaaattactccaccatgcacggtgctgcgatgtcaccattattagaatcggtacatcagggggaatagggattgcaccagggactgttgtaataacggatatagctgtagactccttctttaagccccggtttgaacaggtcattttggacaacattgtcacccgaagtactgaactggacaaagaactgtctgaagaactgttcaactgtagcaaagaaatccccaacttcccaaccctcgttggacatacaatgtgtacctatgatttttatgaaggccaaggccgactagatggagcactgtgctccttttccagagaaaaaaagttagactacttgaagagagcatttaaagctggtgtcaggaatattgaaatggaatctacagtgtttgcagctatgtgtggactctgtggtctaaaagctgctgtggtctgtgtgacacttctcgacagactcgactgtgatcagatcaacttgcctcatgatgtcctggtggagtaccagcaacggcctcagctcctaatctccaacttcatcagacggcggcttggactttgtgactagacgtcctaactgggcagcccaaccctcccctgcaagtttgtagctcaagttgtaatgtgaaagtcatattttatttgtggcatttttatatagttctcatccacatgctaaatggaaagactttatgaaatccttctctcttaaaaaggaatttattgtaaaagaatactcacactaaattaaattcaaatttcattttagaataagttaactaaatcagtctaataattaaaattttaaaactcctggattatgacatttggagtttcatatgcagcattaattaagctcacatcaaaatagaccagccatttgcacatagttaccagtcactctgtttctgaaaccaatccagaaattcatgttagaacattgtcaggcacttctaggtattggacaagtgacagaaactgatcatccatattcaaaatatttacagaaaaaagtgtcagtgaaatgtaggtctatatggaaaagttaccattaggaaaatatggccatactgcttttttacccctgcactatttcagtgcaccacagaataggattcgagatttacatatgcctgtttgtgattttatctcagaatataacaactctggattacattttcctctcaactgaaaaccctcagtaatgcaaagaaaggccttcctttttcttcagaatcacaagtgactaaattgccttctagccattttttcttgtaaaaaaagtgttttgaggaggctgtattttttattccatttcaatattaaccaaataggctgagaaattcatagcaattgaattaagacttgagttcaagatgttaaaggaatccttttgtatgacttgtccagaccggcctattgccctacccgtttgattctctgggaggcatggtgctcctcctggctgcacatgctctctgtgaactgatcgcatcttgggttcttctcaatttgacatacttgggagtcggaatgactggatgggggatgggtagaggatgactggcacacttgtatagtatgtaatgttgtgtacatattatttatatggttgtggctcaaataaagtttaattccaacaca

SEQ ID NO: 198380 - DNA, 2435 bp, Homo sapiens
  Payload ID: 19144
  Gene Name: uridine phosphorylase 2
  Uniprot ID: O95045
  ENST ID: ENST00000605860
  CDS Start-End: 47-1171
ggccgcgcggcacgggtgagtgcccagggacttcaccagtgctgccatgctggccccaggctgtgagttggacccagaccaagaagtggtgaggacaaggcctgaagatgtgcctgcttccccttcaacttccaccatgattgtaagtgtcctgaggcctcccagccatgcttcctgtacagcctgtggaactgtgacttttcacatagtagagagaatggcttcagttatacctgcctccaataggtccatgagatctgacaggaatacatatgttggaaaaaggtttgttcacgttaaaaatccttacttggatttgatggatgaagacattctctatcacttggatttgggaacaaaaacacacaacctaccagcaatgtttggagatgtaaagtttgtctgtgtcggtgggagccccaacagaatgaaagcatttgcactgtttatgcacaaggagctcgggtttgaggaagctgaagaagacataaaagacatctgtgctgggacagacagatactgtatgtacaaaaccgggcctgtgctcgccatcagtcacggcatgggcatcccctccatttctattatgcttcatgaactcatcaaattactccaccatgcacggtgctgcgatgtcaccattattagaatcggtacatcagggggaatagggattgcaccagggactgttgtaataacggatatagctgtagactccttctttaagccccggtttgaacaggtcattttggacaacattgtcacccgaagtactgaactggacaaagaactgtctgaagaactgttcaactgtagcaaagaaatccccaacttcccaaccctcgttggacatacaatgtgtacctatgatttttatgaaggccaaggccgactagatggagcactgtgctccttttccagagaaaaaaagttagactacttgaagagagcatttaaagctggtgtcaggaatattgaaatggaatctacagtgtttgcagctatgtgtggactctgtggtctaaaagctgctgtggtctgtgtgacacttctcgacagactcgactgtgatcagatcaacttgcctcatgatgtcctggtggagtaccagcaacggcctcagctcctaatctccaacttcatcagacggcggcttggactttgtgactagacgtcctaactgggcagcccaaccctcccctgcaagtttgtagctcaagttgtaatgtgaaagtcatattttatttgtggcatttttatatagttctcatccacatgctaaatggaaagactttatgaaatccttctctcttaaaaaggaatttattgtaaaagaatactcacactaaattaaattcaaatttcattttagaataagttaactaaatcagtctaataattaaaattttaaaactcctggattatgacatttggagtttcatatgcagcattaattaagctcacatcaaaatagaccagccatttgcacatagttaccagtcactctgtttctgaaaccaatccagaaattcatgttagaacattgtcaggcacttctaggtattggacaagtgacagaaactgatcatccatattcaaaatatttacagaaaaaagtgtcagtgaaatgtaggtctatatggaaaagttaccattaggaaaatatggccatactgcttttttacccctgcactatttcagtgcaccacagaataggattcgagatttacatatgcctgtttgtgattttatctcagaatataacaactctggattacattttcctctcaactgaaaaccctcagtaatgcaaagaaaggccttcctttttcttcagaatcacaagtgactaaattgccttctagccattttttcttgtaaaaaaagtgttttgaggaggctgtattttttattccatttcaatattaaccaaataggctgagaaattcatagcaattgaattaagacttgagttcaagatgttaaaggaatccttttgtatgacttgtccagaccggcctattgccctacccgtttgattctctgggaggcatggtgctcctcctggctgcacatgctctctgtgaactgatcgcatcttgggttcttctcaatttgacatacttgggagtcggaatgactggatgggggatgggtagaggatgactggcacacttgtatagtatgtaatgttgtgtacatattatttatatggttgtggctcaaataaagtttaattccaacacagtacagattatttggatcccagagccattgtcacacatgaccgaatggaggcttggggcaggaaataggtcctaggccggttgagtctgaattggcctgctcctgggtggggaatgtctttctctttcaagcaatgacaataaacaagaggtatttatcatcaccaataaacaatcccccaagaggta

SEQ ID NO: 198381 - DNA, 2063 bp, Homo sapiens
  Payload ID: 19145
  Gene Name: uridine-cytidine kinase 1
  Uniprot ID: Q9HA47
  ENST ID: ENST00000372208
  CDS Start-End: 86-691
gcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaa

SEQ ID NO: 198382 - DNA, 2051 bp, Homo sapiens
  Payload ID: 19145
  Gene Name: uridine-cytidine kinase 1
  Uniprot ID: Q9HA47
  ENST ID: ENST00000372210
  CDS Start-End: 6-812
ccgagatggcttcggcgggaggcgaagactgcgagagccccgcgccggaggccgaccgtccgcaccagcggcccttcctgatagggtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaa

SEQ ID NO: 198383 - DNA, 2114 bp, Homo sapiens
  Payload ID: 19145
  Gene Name: uridine-cytidine kinase 1
  Uniprot ID: Q9HA47
  ENST ID: ENST00000372211
  CDS Start-End: 27-875
cccgatgcgcgggagcggaggccgagatggcttcggcgggaggcgaagactgcgagagccccgcgccggaggccgaccgtccgcaccagcggcccttcctgataggggacgagcggttccaggcgggaatcccgcttctgtgtctccagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaa

SEQ ID NO: 198384 - DNA, 2167 bp, Homo sapiens
  Payload ID: 19145
  Gene Name: uridine-cytidine kinase 1
  Uniprot ID: Q9HA47
  ENST ID: ENST00000372215
  CDS Start-End: 95-928
gctccggttgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaa

SEQ ID NO: 198385 - DNA, 2237 bp, Homo sapiens
  Payload ID: 19145
  Gene Name: uridine-cytidine kinase 1
  ENST ID: ENST00000491309
  CDS Start-End: 64-720
gggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaaggacgagcggttccaggcgggaatcccgcttctgtgtctccagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgcagagcatctgacagggaatgagagtcagcattgagccaatgagtggttggatgagggaacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaa

SEQ ID NO: 198386 - DNA, 1837 bp, Homo sapiens
  Payload ID: 19146
  Gene Name: uridine-cytidine kinase 1-like 1
  Uniprot ID: Q9NWZ5
  ENST ID: ENST00000354216
  CDS Start-End: 44-1690
tgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 198387 - DNA, 1845 bp, Homo sapiens
  Payload ID: 19146
  Gene Name: uridine-cytidine kinase 1-like 1
  Uniprot ID: Q9NWZ5
  ENST ID: ENST00000358711
  CDS Start-End: 14-1273
gcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagggctgcgctggcctcggcacaccagtgccacccgctgccccggacgctgagcgtcctgaagagcacgccgcaggtacggggcatgcacaccatcatcaggtgagggcccacctggggacggggcggccccgggcgcgtgctcccgctcaactgttggccccacagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagcttt

SEQ ID NO: 198388 - DNA, 1954 bp, Homo sapiens
  Payload ID: 19146
  Gene Name: uridine-cytidine kinase 1-like 1
  Uniprot ID: Q9NWZ5
  ENST ID: ENST00000369908
  CDS Start-End: 301-1902
agtacggtggaggcttcaagggcctcctagctgctgtgcctctgctgacatttggcaggcagcttctgccagccaagggtctcaccccagccacccggctctgcacccactgtgctgcccacaggagtggtcctgcccatggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgaccca

SEQ ID NO: 198389 - DNA, 888 bp, Homo sapiens
  Payload ID: 19146
  Gene Name: uridine-cytidine kinase 1-like 1
  ENST ID: ENST00000430743
  CDS Start-End: 484-888
ctttagttcccccggggagaggctggggacaagctacccattctggggtatgacacctatcagcacgtgtgagcccgccctgtgcccggcccacttctgcttcctcttagcgcaggaggggtcccgcactgggaggggccctcacagcctaccccgctagctttctgcctgatggtgagcttgccccgttgttcgccgccatctttcgcctttgcctgacagctcaggtagggcgacgtctccccccagctcagccccaggcagaagtcaggcccgctctgcacctcgtgctgtgcctggcccgtgtgttcccctcacagtgacgcacagccgtcctgtggggagggagggctctgggaaaagacccccttcttgagtgttccccatcggtttgtccccagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctg

SEQ ID NO: 198390 - DNA, 1375 bp, Homo sapiens
  Payload ID: 19147
  Gene Name: uridine-cytidine kinase 2
  Uniprot ID: Q9BZX2
  ENST ID: ENST00000367879
  CDS Start-End: 304-1089
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaagga

SEQ ID NO: 198391 - DNA, 1083 bp, Homo sapiens
  Payload ID: 19147
  Gene Name: uridine-cytidine kinase 2
  Uniprot ID: Q9BZX2
  ENST ID: ENST00000470820
  CDS Start-End: 700-1035
ggtagagccagaccagacagacgtcgggattctgtacttcctcacaaatgctttctcgtctgtatcctctttcccaaaacttttctttattttccctccttcccttccccttctgtcctttcctccctcctttcaattgcctcaggactggcggggaggggatggagttgttgagagaaaactgtgagtttctgtttttaaagttcagagtgttaggttccataaatgccaggccatgagagcattcctggagacgccttcagagaaaaaaagaaatcacatctgtttttgtctgcctttattcttcattcaacagcaggtttttttaattccaaggagaaggatgtctgccgtgtatttctgtttcatggtgaaagctcagaagtggtcaaaggagacctttgtcccggccgtgatcacccttggctctttggtggtggtccgagggctctgtaagaccatattagccaagtctttagcccccgcttgaagtctgtgggggcaaggaacccagaacccagcccagccagatgttctggcccttgttctctgtcccttgctagcccctgcctggcttggcccattatctgctctgtgctttgcaggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggg

SEQ ID NO: 198392 - DNA, 753 bp, Homo sapiens
  Payload ID: 19147
  Gene Name: uridine-cytidine kinase 2
  Uniprot ID: Q9BZX2
  ENST ID: ENST00000469256
  CDS Start-End: 167-502
actttgttggtttggggtagagccagaccagacagacgtcgggattctgtacttcctcacaaatgctttctcgaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgt

SEQ ID NO: 198393 - DNA, 3149 bp, Homo sapiens
  Payload ID: 19148
  Gene Name: urocanate hydratase 1
  Uniprot ID: Q96N76
  ENST ID: ENST00000290868
  CDS Start-End: 55-2085
agtctcttcctggcctccccacagtgctggcctctgcctccatctcagtcacacatgtctagcctccaggcgctgtgctctggcctgcccctgcggcccctcccagagaaccggggacgccaggctggggtgccccatgcccctgtcaggacccccagcctcagccctgtggagaaacagctggcgctgaggaacgccctgcgctacttccccccggatgtccaggagctgctggccccagagtttgcccaggagctgcaactgtacggacacatctacatgtaccggttttgccccgacattgaaatgagggcctacccgattgagcagtacccctgccagacgaaagtggctgccgccatcatgcacatgattatgaacaacctggatcctgccgtggcccagtttccccaggagctggtgacctatggaggaaatgggcaggtgttcagcaactgggctcagttctggctgaccatgttctacttgtcgaagatgacagaggagcagactttggtcatgtacagtgggcacccacttggcctctttcccagcagccgcagtgccccacggctcgtcatcaccaatgggatggtcattcccaactactcctcccggacggagtatgagaagctctttgccttgggggttacaatgtacggccagatgacagcaggtagctactgctacatcggtccccagggaatcgttcatggcactgtgctcaccgtgttgaatgctgcacgtcggtacctgggcatcgaggacttggctgggaaggtctttgtcacctctgggctcggcggaatgagtggggctcaggccaaggccgcagtcatcgtggggtgcatcggtgtgatagcagaggtggataaagcagcccttgagaaacgccacaggcagggctggctgatggaagtgactgacagcttggaccgctgcatccagaggctcagggaagcaaggaaaaaaaaggaggtgctcagccttggttaccatggcaacgtggtggctctttgggagcgcctggtccacgaattggacacgacgggggagtgcttggtggacctggggtcagatcagacatcctgccacaacccgttcaatggcggctactaccctgtgcagctcagcttcacggaggcccagagcctcatggcctccaaccctgctgtgttcaaggacctggtccaggaaagcctgaggaggcaagtctcagccatcaacaggttggccgaggagaagttcttcttctgggactacggcaatgccttcctcttggaggcccagagagcaggagcggatgtggagaagaaaggtgctggcaggacagagttccgctacccttcctatgtgcagcacatcatgggggacatattctcccagggatttgggcctttccgctgggtgtgcacatcgggggacccccaggacctggcggtcacagacgaactggccacatctgtgctggaggaagccattgctgatggagtgaaggtgtctgtgaagctgcagtacatggacaacatccgctggatccgggaggccgccaggcaccggctggtggtgggctcccaggcaaggatcctgtactcagaccagaagggccgcgtggccatcgctgtggccattaaccaggccatcgcctgcaggaggatcaaggcgccggtggtcctgagccgagatcaccatgacgtgagcggcaccgacagcccctttagggagacctccaacatttacgacggctctgccttctgtgcagacatggctgtgcagaacttcgtgggagatgcctgtcgcggagccacctgggtcgcccttcacaacggagggggcgtgggctggggtgaggtgatcaacgggggattcggcctcgtgctggacggtaccccggaggccgaggggagagccaggctgatgctcagctgggatgtctccaatggtgtggcccggcgctgctggtcagggaaccagaaggcctatgagatcatctgccagaccatgcaggagaacagcaccttggtggtgacactgcctcacaaggtggaggacgagcgggtgctccagcaggccctgcagctctgagggagccaggagtcgcggcccctgcctcccttcctccctggcgatcctcacctgcccagccatggcacacacccttcctgcacacccgcactacctgcacttctcgcacatcctcacgtggcccttatggtgccctgtgcagggtgccaccacagcctcattttacagacagccccctgaggcccagagacatgcagctctctgtccacaaccatgccacttgcatgggagccctgaaggctgtcaaagtccatttagggccaagtcccaagcctgcccgggggccctgcggtgaacactggtcaagctctctccggctgggatgatcacaccctctgcttcctggccacctgccagcctccatgcaactctgtctgtctgctgcccatctgctgtctgtgcaagcaacttctggaccctggcaccctgggctgctggcctggaggagttcgggaaggaggatagaccaggaaataaagggtcaacagagctgtgtgctgcactgtgggctggtgggacgggcaggccgggtctgccctaaggataaatgatcacttactggggaagaaatgagagagcaggggcacccccctaggccagcacagcctgaggggtacagcaaaggggaccctttgctggcccctgaggctggagtctggcaccccttccccaatcccatagcccggtaatgactgggtccagagcctcgtgagaggtcaccgggatgggggaagtggcctctgtcagggccagggctcatgaatctcattctcttagctgggcgtgcaacagaccaacagataactcatcctaaacagagaaatgagaaagagtctgtgggtgggcctctgagggccacagaaaaccagacaccccacatgtcggtggattggagaggggcaggccactgccctctccaggaccaagccgggttcttggtccccaccctccctgcactccgcatctcctccccagcagccattctcccctttcccttgtgaacaaaagcctagttttgtgtgggcagcaatatagggtaaataaaaccacctgattctccagcc

SEQ ID NO: 198394 - DNA, 2735 bp, Homo sapiens
  Payload ID: 19148
  Gene Name: urocanate hydratase 1
  Uniprot ID: Q96N76
  ENST ID: ENST00000383579
  CDS Start-End: 35-2245
acagtgctggcctctgcctccatctcagtcacacatgtctagcctccaggcgctgtgctctggcctgcccctgcggcccctcccagagaaccggggacgccaggctggggtgccccatgcccctgtcaggacccccagcctcagccctgtggagaaacagctggcgctgaggaacgccctgcgctacttccccccggatgtccaggagctgctggccccagagtttgcccaggagctgcaactgtacggacacatctacatgtaccggttttgccccgacattgaaatgagggcctacccgattgagcagtacccctgccagacgaaagtggctgccgccatcatgcacatgattatgaacaacctggatcctgccgtggcccagtttccccaggagctggtgacctatggaggaaatgggcaggtgttcagcaactgggctcagttctggctgaccatgttctacttgtcgaagatgacagaggagcagactttggtcatgtacagtgggcacccacttggcctctttcccagcagccgcagtgccccacggctcgtcatcaccaatgggatggtcattcccaactactcctcccggacggagtatgagaagctctttgccttgggggttacaatgtacggccagatgacagcaggtagctactgctacatcggtccccagggaatcgttcatggcactgtgctcaccgtgttgaatgctgcacgtcggtacctgggcatcgaggacttggctgggaaggtctttgtcacctctgggctcggcggaatgagtggggctcaggccaaggccgcagtcatcgtggggtgcatcggtgtgatagcagaggtggataaagcagcccttgagaaacgccacaggcagggctggctgatggaagtgactgacagcttggaccgctgcatccagaggctcagggtccttcagctgggattgcaacaagccctgggctgggccggcctccctgctgccctgggactgtgtgtcctttcctgctttgtcaaccttgcacccctgggggaggggaggtgcctggctccctcgggcttctccaggccactcctgggggcacctgttctgcttttgtgtccttccagggaagcaaggaaaaaaaaggaggtgctcagccttggttaccatggcaacgtggtggctctttgggagcgcctggtccacgaattggacacgacgggggagtgcttggtggacctggggtcagatcagacatcctgccacaacccgttcaatggcggctactaccctgtgcagctcagcttcacggaggcccagagcctcatggcctccaaccctgctgtgttcaaggacctggtccaggaaagcctgaggaggcaagtctcagccatcaacaggttggccgaggagaagttcttcttctgggactacggcaatgccttcctcttggaggcccagagagcaggagcggatgtggagaagaaaggtgctggcaggacagagttccgctacccttcctatgtgcagcacatcatgggggacatattctcccagggatttgggcctttccgctgggtgtgcacatcgggggacccccaggacctggcggtcacagacgaactggccacatctgtgctggaggaagccattgctgatggagtgaaggtgtctgtgaagctgcagtacatggacaacatccgctggatccgggaggccgccaggcaccggctggtggtgggctcccaggcaaggatcctgtactcagaccagaagggccgcgtggccatcgctgtggccattaaccaggccatcgcctgcaggaggatcaaggcgccggtggtcctgagccgagatcaccatgacgtgagcggcaccgacagcccctttagggagacctccaacatttacgacggctctgccttctgtgcagacatggctgtgcagaacttcgtgggagatgcctgtcgcggagccacctgggtcgcccttcacaacggagggggcgtgggctggggtgaggtgatcaacgggggattcggcctcgtgctggacggtaccccggaggccgaggggagagccaggctgatgctcagctgggatgtctccaatggtgtggcccggcgctgctggtcagggaaccagaaggcctatgagatcatctgccagaccatgcaggagaacagcaccttggtggtgacactgcctcacaaggtggaggacgagcgggtgctccagcaggccctgcagctctgagggagccaggagtcgcggcccctgcctcccttcctccctggcgatcctcacctgcccagccatggcacacacccttcctgcacacccgcactacctgcacttctcgcacatcctcacgtggcccttatggtgccctgtgcagggtgccaccacagcctcattttacagacagccccctgaggcccagagacatgcagctctctgtccacaaccatgccacttgcatgggagccctgaaggctgtcaaagtccatttagggccaagtcccaagcctgcccgggggccctgcggtgaacactggtcaagctctctccggctgggatgatcacaccctctgcttcctggccacctgccagcctccatgcaactctgtctgtctgctgcccatctgctgtctgtgcaagcaacttctggaccctggcaccctgggctgctggcctggaggagttcgggaaggaggatagaccaggaaataaagggtcaacagag

SEQ ID NO: 198395 - DNA, 795 bp, Homo sapiens
  Payload ID: 19149
  Gene Name: urocortin
  Uniprot ID: P55089
  ENST ID: ENST00000296099
  CDS Start-End: 300-674
tgcgtccagtgctgcttccagcgctagccccaggggcacgaaggctggtgtagggaggtgcgcccctccgggggcccgccagccgtcagactcgaagctgtggctgtcattgcttctacaatcagtgcatgttcttcgctgacgtcagtcggagctgtcctggcactatataaggctggcgacagccccgggacagaccctgtgttccccaaggcgtcttcagcctgccccgagggacagagactggagctcaatcttggaccgtacagacgctcgccgacaacctggccggcggcaccatgaggcaggcgggacgcgcagcgctgctggccgcgctgctgctcctggtacagctgtgccctgggagcagccagaggagccccgaggcggccggggtccaggacccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcgggacaacccttctctgtccattgacctcacctttcacctgctgcggaccctgctggagctggcgcggacgcagagccagcgggagcgcgccgagcagaaccgcatcatattcgactcggtgggcaagtgatggcccggtttggggctgcgaaaacgttgacccctttcccccaccccagagttgggatgcggggcagagccaccagggcactgtctgcgtgactattttttaataaaagtactgaagaccc

SEQ ID NO: 198396 - DNA, 1481 bp, Homo sapiens
  Payload ID: 19150
  Gene Name: urocortin 2
  Uniprot ID: Q96RP3
  ENST ID: ENST00000273610
  CDS Start-End: 84-422
ggacagtagtgcctggccccagccccaggcagccacagcaggctgccttaccccagaagcagctggtggcgcctgacctcacgatgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcattgtcctatcgctggatgtccccatcggcctcttgcagatcttactggagcaagcccgggccagggctgccagggagcaggccaccaccaacgcccgcatcctggcccgtgtcggccactgctgagcctgagagagggggtcacagtgatagggccaccctggatgggaagacctggagggcagccacacagctggacggatgctgccacatctgggcatacagtgtctggacgctgccacatctgggcatacagtgtctggacactgccacatggagccactgtcatgcaggtcatatcagatctgagtgccccacagagtcacagtgtgtctggacagcctggacattggacattgctaagttgggtcactgccacatggagtcttgccatgcctgtgtgccccacagacctaatatatgtccggacagcttggatgctgccacgtaaggtcactgctgtggcgagtcttgctatgtctgggtgccccatagtcacagaacacctggacaccgccacatgcagtcatcatcatgttactttcaggagcctcaacacgagagctcaacactgcctccgaccagtccctctgaggcccacaggtctgtcatcccataggccaccacacagagaaatgctggctgagggtcacttgcttgctctgtgccccatgaggcagcacctgccccagatggacggggctgtgaggggtgtctccaggcacaaaggcccgaacacaggaagcctgtgaccatggcagccttgtcttatgggcgcatatgtgcgtgtgtggctgagtctctgacagctgtgagtgtgtgtgagcagggtaagggtacgtgaggggtctgagaggagtgggtgcttgtcccccaaacctgcatgaagcaagaacaactcctggccaggccctgtcctccccacgtacccctgcatccccagcctcgacccagggacatgcagggctcacaggagacagggctcaggctgccggagctccaaccaaactctgtcccacttcacgcacggactgtcctgggcaaaggtgttcacctttccgagcctcggtttccttatctgtaaagcaaagcgacaccagcaagcctgtgagcattgtgtatatagcagacatggaggtcctgcagcaggaggtgctcaataaacacaaagcgactgaaggatgg

SEQ ID NO: 198397 - DNA, 1200 bp, Homo sapiens
  Payload ID: 19151
  Gene Name: urocortin 3
  Uniprot ID: Q969E3
  ENST ID: ENST00000380433
  CDS Start-End: 229-714
gatccaccctgtgatctgtcacttttatatacacacaggggaggggaccgtttccatagagagggaatatcacagcccacttaggaacaataccggagaagcaggagccgagaccccggagcagccacaagttcatggggacgtgcacggggccgccctcctggccctgaagctgcgccggcctccctgagcgtttcgctgcggagggaagtccactctcggggagagatgctgatgccggtccacttcctgctgctcctgctgctgctcctggggggccccaggacaggcctcccccacaagttctacaaagccaagcccatcttcagctgcctcaacaccgccctgtctgaggctgagaagggccagtgggaggatgcatccctgctgagcaagaggagcttccactacctgcgcagcagagacgcctcttcgggagaggaggaggagggcaaagagaaaaagactttccccatctctggggccaggggtggagccagaggcacccggtacagatacgtgtcccaagcacagcccaggggaaagccacgccaggacacggccaagagtccccaccgcaccaagttcaccctgtccctcgacgtccccaccaacatcatgaacctcctcttcaacatcgccaaggccaagaacctgcgtgcccaggcggccgccaatgcccacctgatggcgcaaattgggaggaagaagtagaggcggaggctggacgggagggcagcggggtggggagggggaggggagggggaggggagggcgagggggggaggggagggggagggtgctgtctgctggtttgtgttttgtgggatcagtcagttttacaggttgctgcactgctgagcccctctgatctcttctggcctttgaccctgtctccctcctgctctgtctgtacacacagaagtgcagtattgtccaaccttcccagacacaaagcagctaacgttcctccctgtactcagcgtctccttcctccctccccacagcaagaggcaaagttcatgcattcctcctctccagtcttctctctgttgaccccatgcctgagaagagagcgttcagggctcctctcccacacatcaacttcttccagggcagaaagaggagctgcagcactcgccttcctgccaccgaatccttccctacctcctcaccccattaaaacaatggcttcttcaa

SEQ ID NO: 198398 - DNA, 2477 bp, Homo sapiens
  Payload ID: 19152
  Gene Name: uromodulin
  Uniprot ID: P07911
  ENST ID: ENST00000302509
  CDS Start-End: 293-2215
aacaacaacctcacagcttggacaaggcaaacattatgccaggaggaaaaaatattccacccccaagaaaacaatatcaaaaaacagaactagagactaattggaggagagattgccagcctggggcaaatgtgtatatataagtatgaggcacatcatgaccagactaactctacctttctggcttcaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctc

SEQ ID NO: 198399 - DNA, 2408 bp, Homo sapiens
  Payload ID: 19152
  Gene Name: uromodulin
  Uniprot ID: P07911
  ENST ID: ENST00000396134
  CDS Start-End: 125-2146
aactctacctttctggcttcaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagaacaaagtacaactgcccagccaggtggagttggaggactccgcagagaggaggcgacactgagcagggtcctgatgaagatttcaccagccagggaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctc

SEQ ID NO: 198400 - DNA, 2399 bp, Homo sapiens
  Payload ID: 19152
  Gene Name: uromodulin
  ENST ID: ENST00000396138
  CDS Start-End: 68-2137
aaaaaacagaactagagactaattggaggagagattgccagcctggggcaaatgtgtatatataagtatgaggcacatcatgaccagactaactctacctttctggcttcaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctc

SEQ ID NO: 198401 - DNA, 546 bp, Homo sapiens
  Payload ID: 19152
  Gene Name: uromodulin
  ENST ID: ENST00000570972
  CDS Start-End: 459-546
aatactggcatccaccctggactatttttccaattggaagaaatagtaagtgaccactccagaaacatttaaatgcattgtgaaggttaattacctctcaagttgctcgtctcaagccacttctttacgatatgtgagttgcatgaaggagcagactgccatgttcattgttctccatggtgactagctccctgtttggcacaatgtagctactcaatagatgtttgttgaatgaataagtgatccaggcaaattgaaagtttccaggcagaggatcagttaaaatccaaagctgccttcagtaaagtggtgagtccagaacactattccatctggctacttcctgctccaaatgactgagttcttcaaaatgtgcaatgtgctgagaattggggagccaagactgggatgttggtgaggtgctatctagacctgaagtagcgggaagagcagaaaggatggggcagccatctctgacttggatgctgatggtggtggtggcctcttggttcatcacaactgcagccactgacacctcagaagcaa

SEQ ID NO: 198402 - DNA, 589 bp, Homo sapiens
  Payload ID: 19152
  Gene Name: uromodulin
  ENST ID: ENST00000571174
  CDS Start-End: 214-589
agactaactctacctttctggcttcaggtaaggctatctgtagctgtcttctcctagcccagcttctccccatcctatttgagggaggtaggagaggaaattaagaccttggacactggggtcagacctggatttgagtcattattctgccaattattggcttcatgatctttagtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacat

SEQ ID NO: 198403 - DNA, 537 bp, Homo sapiens
  Payload ID: 19152
  Gene Name: uromodulin
  ENST ID: ENST00000570757
  CDS Start-End: 273-537
taactctacctttctggcttcaggtaaggctatctgtagctgtcttctcctagcccagcttctccccatcctatttgagggaggtaggagaggaaattaagaccttggacactggggtcagacctggatttgagtcattattctgccaattattggcttcatgatctttagacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggct

SEQ ID NO: 198404 - DNA, 559 bp, Homo sapiens
  Payload ID: 19152
  Gene Name: uromodulin
  ENST ID: ENST00000577168
  CDS Start-End: 146-559
aacaacaacctcacagcttggacaaggcaaacattatgccaggaggaaaaaatattccacccccaagaaaacaatatcaaaaaacagaactagagactaattggaggagagattgccagcctggggcaaatgtgtatatataagtatgaggcacatcatgaccagactaactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggat

SEQ ID NO: 198405 - DNA, 545 bp, Homo sapiens
  Payload ID: 19152
  Gene Name: uromodulin
  ENST ID: ENST00000573567
  CDS Start-End: 62-545
aactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagaacaaagtacaactgcccagccaggtggagttggaggactccgcagagaggaggcgacactgagcagggatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccg

SEQ ID NO: 198406 - DNA, 2315 bp, Homo sapiens
  Payload ID: 19152
  Gene Name: uromodulin
  Uniprot ID: P07911
  ENST ID: ENST00000570689
  CDS Start-End: 148-2070
agatcatgtggcatagagcccctgacaggccacgagccagagaatgggtgtgccacctccaggtcccccaggcgtaactggagcctcaggaggtgtgtgctcagagaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaat

SEQ ID NO: 198407 - DNA, 737 bp, Homo sapiens
  Payload ID: 19152
  Gene Name: uromodulin
  ENST ID: ENST00000574195
  CDS Start-End: 255-737
gcagaggatcagttaaaatccaaagctgccttcagtaaagtggtgagtccagaacactattccatctggctacttcctgctccaaatgactgagttcttcaaaatgtgcaatgtgctgagaattggggagccaagactgggatgttggtgaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagaacaaagtacaactgcccagccaggtggagttggaggactccgcagagaggaggcgacactgagcagggtcctgatgaagatttcaccagccagggaagcagaaaacataaaatgtgcaaagaaagggaggggcaacaggttcaccgtaaatcctaccaaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcaca

SEQ ID NO: 198408 - DNA, 543 bp, Homo sapiens
  Payload ID: 19152
  Gene Name: uromodulin
  ENST ID: ENST00000576546
  CDS Start-End: 286-543
acgatatgtgagttgcatgaaggagcagactgccatgttcattgttctccatggtgactagctccctgtttggcacaatgtagctactcaatagatgtttgttgaatgaataagtgatccaggcaaattgaaagtttccaggcagaggatcagttaaaatccaaagctgccttcagtaaagtggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacg

SEQ ID NO: 198409 - DNA, 526 bp, Homo sapiens
  Payload ID: 19152
  Gene Name: uromodulin
  ENST ID: ENST00000576688
  CDS Start-End: 219-526
agactaactctacctttctggcttcaggcagaggatcagttaaaatccaaagctgccttcagtaaagtggtgagtccagaacactattccatctggctacttcctgctccaaatgactgagttcttcaaaatgtgcaatgtgctgagaattggggagccaagactgggatgttggtgaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccgg

SEQ ID NO: 198410 - DNA, 1106 bp, Homo sapiens
  Payload ID: 19153
  Gene Name: uromodulin-like 1
  ENST ID: ENST00000400421
  CDS Start-End: 1-728
accctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaagtacgttcttgagaagttggactttcagagctaaattctggaacctcccgggcaggttggaacccattggtcaccctgatgttgggggcctgagtaagggcctcgtcgtatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttcc

SEQ ID NO: 198411 - DNA, 5516 bp, Homo sapiens
  Payload ID: 19153
  Gene Name: uromodulin-like 1
  Uniprot ID: Q5DID0
  ENST ID: ENST00000400424
  CDS Start-End: 397-4137
cgctggtttcctctggaggctgcgagggagaaaccgtcccctgcctctcccaggctctggggtgagcccttcctggcatcccgggctcattgtagatggatcactccaatctccatggcttctcagggcttccctccatgcacctcaaatctctctctccttccttttgtaaggatgccagtcattggatttaggttcaccttaaatccaggatgatctcatctaaattacatctgcaaaaagaccctttttccaaaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctcacacctgaaagtagagtgtttttcctcagtgaacttagaattataacatggccttagttttcaacccatgatactaattttgttgaatataattaattgtcattcatacagaacatttggggaaaggagtattttgatttactggatattctcagagtcagtaaagaatgacagtgggtaatatgtgtggatcacagattctgatcaagtagaatcaatcgcataagacactgaaatgtggctggttgtgctggatgctccatttgggatggtccatcacaggctcgctgagcatccaacgagggccggtgctgtgttgggcacgctggggaggccagaaacgcatctctggttcttcccaagtcatgtcccgctgttctgatgtcagctgaggagctttcacttgcctttcttggaagagcatgacacatattcagtaaaaccagctgttgagcccc

SEQ ID NO: 198412 - DNA, 5442 bp, Homo sapiens
  Payload ID: 19153
  Gene Name: uromodulin-like 1
  Uniprot ID: Q5DID0
  ENST ID: ENST00000400427
  CDS Start-End: 397-4521
cgctggtttcctctggaggctgcgagggagaaaccgtcccctgcctctcccaggctctggggtgagcccttcctggcatcccgggctcattgtagatggatcactccaatctccatggcttctcagggcttccctccatgcacctcaaatctctctctccttccttttgtaaggatgccagtcattggatttaggttcaccttaaatccaggatgatctcatctaaattacatctgcaaaaagaccctttttccaaaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggaggtgcccagcactgccccgggtctggggatggaccaggggagccccagccaggtgaaccccagccaggggagccccagccaggggagcctcagacaggagagtaccagccaggcgagccccagccagaggagcaccagccaggggagccccagccaggtgaaccccagccagcggagcaccagccacgcgaactccagccaggggagccccagccaggggagccccagccaggagagccccagccaggggagcaccagccaggcgagccccagccataggaacactatcggggtgataggcaccacctcctccccgaaggctactgggtcaacccacagcttccctcctggggccacagatggcccactggccctccctggacagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 198413 - DNA, 5262 bp, Homo sapiens
  Payload ID: 19153
  Gene Name: uromodulin-like 1
  Uniprot ID: Q5DID0
  ENST ID: ENST00000408989
  CDS Start-End: 1-4341
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggaggtgcccagcactgccccgggtctggggatggaccaggggagccccagccaggtgaaccccagccaggggagccccagccaggggagcctcagacaggagagtaccagccaggcgagccccagccagaggagcaccagccaggggagccccagccaggtgaaccccagccagcggagcaccagccacgcgaactccagccaggggagccccagccaggggagccccagccaggagagccccagccaggggagcaccagccaggcgagccccagccataggaacactatcggggtgataggcaccacctcctccccgaaggctactgggtcaacccacagcttccctcctggggccacagatggcccactggccctccctggacagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 198414 - DNA, 4878 bp, Homo sapiens
  Payload ID: 19153
  Gene Name: uromodulin-like 1
  Uniprot ID: Q5DID0
  ENST ID: ENST00000408910
  CDS Start-End: 1-3957
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 198415 - DNA, 1082 bp, Homo sapiens
  Payload ID: 19153
  Gene Name: uromodulin-like 1
  ENST ID: ENST00000485357
  CDS Start-End: 1-236
accctgtgggctcctggtacaacgtcaccatactggtgaaaatggacttcaaggaactccagcaagtggaccccaggctcctgaaccacatgcgccttctgcattccttgatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagagacgaggtctcactgagtagcccaggctgttctcaagctcccagcctcaagagatccttcctccttggcctcacaaagcgctgggattgcaggcaggagaccccgtgttcagcctaagcacgtggccttgagatccacttagaacttcgcgccacgtccacatcccacggcaccccactaagctctgcagagaactgtctatagattcctgctctgtggcttccagggtgagaatcctgtccctttcgtgagcacagaaggttggaaaacagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttcc

SEQ ID NO: 198416 - DNA, 1093 bp, Homo sapiens
  Payload ID: 19153
  Gene Name: uromodulin-like 1
  ENST ID: ENST00000468982
  CDS Start-End: 1-329
accctgtgggctcctggtacaacgtcaccatactggtgaaaatggacttcaaggaactccagcaagtggaccccaggctcctgaaccacatgcgccttctgcattccttgcttgttaaggggactgcccaattggccagtaagaaactagctctgaagccacactgcctggccctagtgttgccactcatcagctgtgtgaccttgggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttcc

SEQ ID NO: 198417 - DNA, 1150 bp, Homo sapiens
  Payload ID: 19153
  Gene Name: uromodulin-like 1
  ENST ID: ENST00000466434
  CDS Start-End: 1-524
accctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagcacgtggccttgagatccacttagaacttcgcgccacgtccacatcccacggcaccccactaagctctgcagagaactgtctatagattcctgctctgtggcttccagggtgagaatcctgtccctttcgtgagcacagaaggttggaaaacagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttcc

SEQ ID NO: 198418 - DNA, 917 bp, Homo sapiens
  Payload ID: 19153
  Gene Name: uromodulin-like 1
  ENST ID: ENST00000497243
  CDS Start-End: 1-341
accctgtgggctcctggtacaacgtcaccatactggtgaaaatggacttcaaggaactccagcaagtggaccccaggctcctgaaccacatgcgccttctgcattccttggtaggtgagacagacgggggctgcctgcaccctccttgtggcagctgctcaggcagacccaggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttcc

SEQ ID NO: 198419 - DNA, 1262 bp, Homo sapiens
  Payload ID: 19153
  Gene Name: uromodulin-like 1
  ENST ID: ENST00000491559
  CDS Start-End: 1-416
accctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagagacgaggtctcactgagtagcccaggctgttctcaagctcccagcctcaagagatccttcctccttggcctcacaaagcgctgggattgcaggcaggagaccccgtgttcagcctaagcacgtggccttgagatccacttagaacttcgcgccacgtccacatcccacggcaccccactaagctctgcagagaactgtctatagattcctgctctgtggcttccagggtgagaatcctgtccctttcgtgagcacagaaggttggaaaacagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttcc

SEQ ID NO: 198420 - DNA, 4198 bp, Homo sapiens
  Payload ID: 19154
  Gene Name: uronyl-2-sulfotransferase
  Uniprot ID: Q9Y2C2
  ENST ID: ENST00000367463
  CDS Start-End: 104-1324
cggccctccccatgtgcagccggccagccgggctctcctcctcgcggcggatgggtgaccttttcctggcacgggcaggctgtgggaggcagcggagcaggcgatgaagaagaagcagcagcatcccggcggcggcgcggatccctggccccatggggcccctatggggggcgcccctccgggcctgggcagctggaagcgtcgggtgcccctgctgcctttcctgcgcttctccctccgggactacggcttctgcatggccaccctgctggtcttctgcctgggctccctcctctatcagctcagcgggggaccccctcgcttcctgctcgacctgcggcagtacttgggaaattccacttacttggatgaccatggaccacctcctagtaaggtactacctttcccaagccaggtggtgtacaacagggtaggcaagtgtgggagccgtactgtggtcttgcttctgagaatcttgtcggagaagcacggatttaatttggtcacatcagacattcacaacaaaaccaggcttactaaaaatgaacaaatggaactgattaaaaatataagtactgccgaacaaccctatttattcactcgacatgttcatttcctcaacttctcaaggtttggaggagaccagcctgtctacatcaacatcattagagaccccgtcaaccggttcttatccaactattttttccgtcgctttggagactggagaggggaacaaaatcacatgatccgcacccccagcatgaggcaggaggagcgctacctggatatcaatgagtgtattcttgaaaactatcccgagtgctccaaccccaggttattttacatcattccgtacttttgtggacagcatcccagatgcagggagcctggtgaatgggcccttgagagagcaaagctgaacgtgaatgaaaacttcctgctcgtggggattcttgaagagttggaagatgtgctgctgttactggaaagatttttacctcattacttcaagggcgtgctcagtatctacaaagacccagagcacaggaagcttggaaacatgactgtgacggtgaagaagactgtcccctctcctgaggctgtgcagatcctctaccagcggatgagatacgagtacgagttttaccactacgtcaaagagcagttccacctgctgaagcgcaagtttggacttaagtctcacgtcagcaagccccccctgaggccacacttctttatcccaactccactggaaaccgaggagccaatcgacgatgaagaacaggatgatgaaaagtggctggaagatatttataagaggtgatgtgactgtgttgcctctatggctttatctcccttttccagaaagttctttgtttggggaagtaaaatccttaagggactaaattaatgcttgggtgcattaaaaagaacaaaacattcccacatgttggggtcattgggagatgcccggttttgcgggttttatttgtttaattttattctgtgttttctcttggctctttgggtctttcccgggtacactagatggctccatcccaaggcatcttgtcataaaacagctttcccccaccccatatcatgggaaaagggggagaaatatagcccctagcctaataacttatcatttgtaaaatgacttataaaaatattacctcaatggtaggagacatccagacttgtatatttcagtggaaatacaaaaccacttcagagaccagggtatctcctctggaaggatctaagagaaggtaagacagattaggacatcgaaaaggaggatggagccaggtgccatggcttgagcctataatccgaggctgaggtgggaggatcacttgagcccaggagtttgaggttgcagtgagctgtgatcacaccactgcactccagcctgggtgacagagtgagactctgtctcaattaattttttttttttaaaggaggaggatctccatgggtaagtggtttctacccgcatgggtagagttctgcctctggtccttctcagggggcactttcaccaagagcagtgtaattatctctgaaagagcaagtcagcttgtgccgcatccccaaccaatccacagcctggagtacctttcaaggtcaaagtgcatggccagctccattgagacattccatttcaaagcaccgtgctgacagatatcaaagtactctagcagggaaaataatttgtttgctgtgtaaggaagaatgtagacaagacagataaatctgaaggtcatgtggcatcagggaaagggcatggctgtgtcttttgcacccaatatgaaacatcttctcccaacactgctttaatggaagttctaggaaccaatttagctcaggcatttgactcctacagcagaagttctgagcctgaccacagatggtgtgtaatctatcaaacacacccctggccaagttgggtcctataggacctggtactatgtactattgtaacttctagttccctaagaggtacctgttttcagtaaaaaggggtcctgagttctgtgcaggtggaagagctacccgagaactacctgagttctgtgcaggtagagtcccatttcttatgggacctgtgtgctcctgagaactcttacttgagacatcaaaaagaagcagcaagagcttctgggacagagactgcttggccagctttgtaagtaagtggctgcctccaatgtgatgtgagtacatgttgggcagtctcactgtcctaaggtatgtcttctttccacctcccactgcccctcccctgccacctatcaatgatgccttggttcagtcattagaaatctgttgctttgagttctgaaatattttcaccttaaaaaaaatgctgaaaatacacattctcctgggaagacgataaacagctagctaagaagccgaggttcagtggtggcagcaggaaggacactgccacaaattttgtctatttcatatttgtcccctagagccagccctagcaaatgtgtgagttgggagtagttaatagtaaataagactctgactttacacaagctacacattttatacttttcataaaccacaaagtctctctagaattttttctgccttcactaaaattggactgtagccaagatataaagcaagtcatttggaacctgccgagtgagcactgaagctactttatcatgagatgtgtgttaagaaggctgcagcccacaggagtccagggaaggcggggaccacagaggcacagagtccagcacttggccgctcatgggccttctttctgcctcagaggacgggggcagagaagtgatgaagggaaatgttcttagaggaggaaatatcctttgtcctgttcagagagaccagggccctaccattaggcatactttcagaagcaacctggagaacagctatcaatcatattcaaaaccagtacaagaactgctgcctggtaccctgtgagtcatttctatgaaattccatataaagaatgatgataagtttacacactgtgcaatctcacaatctgaaaataaagttgagttggctgtgttttctctgctcttgtcagaacattgggacaattggtcgttcaaaaacattcatcctcttactgcaagtttatctgggtacttttacctgtgtgttcaaaggcatttcttttcagcagtgatcattataacttcacaaaaaaagatgctgacggatttacttacagggccttaatgttattttgtcccagccaacaccctctaggtcctaaaagtcaaggtacttcagtttatttggcaaacatgacaacattttttttggccctgggcccaacagtttgtacttcatgaaacatattgtacattttacatagtttaatttaaaaaataccttttaagctagttgatctttgactgtcttatttattataacctttcagcacattccaaggttttagttactcaggaaggagttaattaaaatgattttattttggtctgatggatgttttttaaaaggaaaattattattatgaaccttcagcctactttcttgagtgccgtaaaagtgcttgtaaatctttttttttttttaagaagaaagaaaaaaatggtgtttgacgttgatggaaattcaaaaatatatatggaactgaaacattaacttagctaaaataaaagcaatctgtgtttga

SEQ ID NO: 198421 - DNA, 1223 bp, Homo sapiens
  Payload ID: 19155
  Gene Name: uroplakin 1A
  Uniprot ID: O00322
  ENST ID: ENST00000222275
  CDS Start-End: 1-777
atggcgtctgcggcagcagcggaggccgagaagggatctccagttgtggtgggcctgctagttgtgggcaatatcattattctgctgtcaggcctgtccctgtttgctgagaccatatgggtgacagccgaccagtaccgtgtatacccactgatgggagtctcaggcaaggatgacgtcttcgctggtgcctggattgccatcttctgcggcttctccttcttcatggtagccagttttggtgtgggtgccgcactctgccgccgccggtccatggtcctcacgtacctggtgctcatgctcatcgtctacatcttcgagtgcgcctcctgcatcacgtcctacacccaccgtgactacatggtgtccaacccatccctgatcaccaagcagatgctgaccttctacagcgcggacaccgaccagggccaggagctgacccgcctctgggaccgcgtcatgattgagcaagaatgctgtggcacatctggtcccatggactgggtgaacttcacgtcagccttccgggcggccactccggaggtggtgttcccctggcccccactgtgctgtcgccggacgggaaacttcatccccctcaacgaggagggctgccgcctggggcacatggactacctgttcaccaagggctgcttcgaacacatcggccacgccatcgacagctacacgtggggtatctcgtggtttgggtttgccatcctgatgtggacgctcccggtcatgctgatagccatgtatttctacaccatgctctgagggacaggaggggaaggcaacatacacaccccggactcctccgcatcctcctcctgcttcctccgctgggcctggatggctgcctcacctctcacctcccaacgtccctagcccttacgtccttccacttccaagatctttttccaggttcctgagccctactgtgtctcaggtgtgccctgaaaccccagggcttgtgtgcacatatccttagcccatctttcaagggacctctccatgatcccacctcccattcacagatacctctcttgtagctctctgacctcctccttcatggcaggcatcgccattcttgctgaaccgtttgtgattgccatttgagctctggaagcctctattgccatgagagttctgtcacggtcactttactgtccccatcatcacccagcacggggctaagcatatactagatagtcaataaataa

SEQ ID NO: 198422 - DNA, 1016 bp, Homo sapiens
  Payload ID: 19155
  Gene Name: uroplakin 1A
  Uniprot ID: O00322
  ENST ID: ENST00000379013
  CDS Start-End: 1-822
atggcgtctgcggcagcagcggaggccgagaagggatctccagttgtggtgggcctgctagttgtgggcaatatcattattctgctgtcaggcctgtccctgtttgctgagaccatatgggtgacagccgaccagtaccgtgtatacccactgatgggagtctcaggcaaggatgacgtcttcgctggtgcctggattgccatcttctgcggcttctccttcttcatggtagccagttttggtgtgggtgccgcactctgccgccgccggtccatggtcctcacgtacctggtgctcatgctcatcgtctacatcttcgagtgcgcctcctgcatcacgtcctacacccaccgtgactacatggtgtccaacccatccctgatcaccaagcagatgctgaccttctacagcgcggacaccgaccagggccaggagctgacccgcctctgggaccgcgtcatgattgagcaagaatgctgtggcacatctggtcccatggactgggtgaacttcacgtcagccttccgggcggccactccggaggtggtgttcccctggcccccactgtgctgtcgccggacgggaaacttcatccccctcaacgaggagggctgccgcctggggcacatggactacctgttcaccaaggctggagtacagtggcacaatctcagctcactgcagcgtctgcctcccgggttcaagggattctcccacctcagcttccagagcagctgggattacagggctgcttcgaacacatcggccacgccatcgacagctacacgtggggtatctcgtggtttgggtttgccatcctgatgtggacgctcccggtcatgctgatagccatgtatttctacaccatgctctgagggacaggaggggaaggcaacatacacaccccggactcctccgcatcctcctcctgcttcctccgctgggcctggatggctgcctcacctctcacctcccaacgtccctagcccttacgtccttccacttccaagatcttt

SEQ ID NO: 198423 - DNA, 1366 bp, Homo sapiens
  Payload ID: 19155
  Gene Name: uroplakin 1A
  Uniprot ID: O00322
  ENST ID: ENST00000616789
  CDS Start-End: 28-849
cagagaggctgcagacagagaaggatgatggcgtctgcggcagcagcggaggccgagaagggatctccagttgtggtgggcctgctagttgtgggcaatatcattattctgctgtcaggcctgtccctgtttgctgagaccatatgggtgacagccgaccagtaccgtgtatacccactgatgggagtctcaggcaaggatgacgtcttcgctggtgcctggattgccatcttctgcggcttctccttcttcatggtagccagttttggtgtgggtgccgcactctgccgccgccggtccatggtcctcacgtacctggtgctcatgctcatcgtctacatcttcgagtgcgcctcctgcatcacgtcctacacccaccgtgactacatggtgtccaacccatccctgatcaccaagcagatgctgaccttctacagcgcggacaccgaccagggccaggagctgacccgcctctgggaccgcgtcatgattgagcaagaatgctgtggcacatctggtcccatggactgggtgaacttcacgtcagccttccgggcggccactccggaggtggtgttcccctggcccccactgtgctgtcgccggacgggaaacttcatccccctcaacgaggagggctgccgcctggggcacatggactacctgttcaccaaggctggagtacagtggcacaatctcagctcactgcagcgtctgcctcccgggttcaagggattctcccacctcagcttccagagcagctgggattacagggctgcttcgaacacatcggccacgccatcgacagctacacgtggggtatctcgtggtttgggtttgccatcctgatgtggacgctcccggtcatgctgatagccatgtatttctacaccatgctctgagggacaggaggggaaggcaacatacacaccccggactcctccgcatcctcctcctgcttcctccgctgggcctggatggctgcctcacctctcacctcccaacgtccctagcccttacgtccttccacttccaagatctttttccaggttcctgagccctactgtgtctcaggtgtgccctgaaaccccagggcttgtgtgcacatatccttagcccatctttcaagggacctctccatgatcccacctcccattcacagatacctctcttgtagctctctgacctcctccttcatggcaggcatcgccattcttgctgaaccgtttgtgattgccatttgagctctggaagcctctattgccatgagagttctgtcacggtcactttactgtccccatcatcacccagcacggggctaagcatatactagatagtcaataaataaataaataatgaatgaatg

SEQ ID NO: 198424 - DNA, 1268 bp, Homo sapiens
  Payload ID: 19155
  Gene Name: uroplakin 1A
  Uniprot ID: O00322
  ENST ID: ENST00000617999
  CDS Start-End: 28-804
cagagaggctgcagacagagaaggatgatggcgtctgcggcagcagcggaggccgagaagggatctccagttgtggtgggcctgctagttgtgggcaatatcattattctgctgtcaggcctgtccctgtttgctgagaccatatgggtgacagccgaccagtaccgtgtatacccactgatgggagtctcaggcaaggatgacgtcttcgctggtgcctggattgccatcttctgcggcttctccttcttcatggtagccagttttggtgtgggtgccgcactctgccgccgccggtccatggtcctcacgtacctggtgctcatgctcatcgtctacatcttcgagtgcgcctcctgcatcacgtcctacacccaccgtgactacatggtgtccaacccatccctgatcaccaagcagatgctgaccttctacagcgcggacaccgaccagggccaggagctgacccgcctctgggaccgcgtcatgattgagcaagaatgctgtggcacatctggtcccatggactgggtgaacttcacgtcagccttccgggcggccactccggaggtggtgttcccctggcccccactgtgctgtcgccggacgggaaacttcatccccctcaacgaggagggctgccgcctggggcacatggactacctgttcaccaagggctgcttcgaacacatcggccacgccatcgacagctacacgtggggtatctcgtggtttgggtttgccatcctgatgtggacgctcccggtcatgctgatagccatgtatttctacaccatgctctgagggacaggaggggaaggcaacatacacaccccggactcctccgcatcctcctcctgcttcctccgctgggcctggatggctgcctcacctctcacctcccaacgtccctagcccttacgtccttccacttccaagatctttttccaggttcctgagccctactgtgtctcaggtgtgccctgaaaccccagggcttgtgtgcacatatccttagcccatctttcaagggacctctccatgatcccacctcccattcacagatacctctcttgtagctctctgacctcctccttcatggcaggcatcgccattcttgctgaaccgtttgtgattgccatttgagctctggaagcctctattgccatgagagttctgtcacggtcactttactgtccccatcatcacccagcacggggctaagcatatactagatagtcaataaataaataaataatgaatgaatg

SEQ ID NO: 198425 - DNA, 2118 bp, Homo sapiens
  Payload ID: 19156
  Gene Name: uroplakin 1B
  Uniprot ID: O75841
  ENST ID: ENST00000264234
  CDS Start-End: 150-932
atcacagactacccttccctggtcctggaggttcaaagaattgcaggagggtagaaaagcacctgggtcgggtgcagactgcggagcgggccctaccgtgtgcgcagaaagaggaggcgcttgccttcagcttgtgggaaatcccgaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactttttgggttctcctgggtaccatgttctactggagcagaattgaatattaagcataaagtgttgccaccatacctccttccccgagtgactctggatttggtgctggaaccagctctctcctaatattccacgtttgtgccccacactaacgtgtgtgtcttacattgccaagtcagatggtacggacttcctttaggatctcaggcttctgcagttctcatgactcctacttttcatcctagtctagcattctgcaacatttatatagactgttgaaaggagaatttgaaaaatgcataataactacttccatccctgcttatttttaatttgggaaaataaatacattcgaaggaacctgtgttatcacagtaacccagagctgtatttggctagcaatctgcctgtatctctcactattatctaaaagaaaccttccaatgcttctgttgatctcagtattgtcaggggaacagagaagttgggaaaagattactgaaatataccttttgcatttctttctagagtagctcccatatatggagatgggtgattctcttgatgccaccttcagatccttttattctccagaataattcttaacagtggttcaaatttcctttcataccttgaagtatgtgtttagtagcctcaattctccattaattaaaagtgtgggctgggcgtgggggctcatgcctgtaatcccagcactttgggaggccgaggtgggcagatcacctgaggtcaggagttcaagaccagcctggccaacatggtgaaaccccgtctctacaaaaatacaaaaattagccaggcgtgatggcaggtgcctgtaatcctagctacttggcaggctaacgcaggagaatcacttgaccgggagacagaggttgcagtgagctgagatcgtacctattgcactccatcctggatgaaagagccagactctgtctcaaaacaaacaaaaaagcgtggggacttctggggacagacaaggtgcctgttatatatttactcagtctttgccctgaatggtctcagcttgagaccatttcaaactggagagaagcaagccagccaatagaatggggtgatttacagggatttctgtttactgtcaaaatatttctcatctgcactatgtttccatttgtggtcctgaaggaaattcttataactcaacatttgtctggtcttataagtaaagacagctttaaaatctgttcactttca

SEQ ID NO: 198426 - DNA, 1937 bp, Homo sapiens
  Payload ID: 19156
  Gene Name: uroplakin 1B
  ENST ID: ENST00000460625
  CDS Start-End: 5-763
gaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactttttgggttctcctgggtaccatgttctactggagcagaattgaatattaagcataaagtgttgccaccatacctccttccccgagtgactctggatttggtgctggaaccagctctctcctaatattccacgtttgtgccccacactaacgtgtgtgtcttacattgccaagtcagatggtacggacttcctttaggatctcaggcttctgcagttctcatgactcctacttttcatcctagtctagcattctgcaacatttatatagactgttgaaaggagaatttgaaaaatgcataataactacttccatccctgcttatttttaatttgggaaaataaatacattcgaaggaacctgtgttatcacagtaacccagagctgtatttggctagcaatctgcctgtatctctcactattatctaaaagaaaccttccaatgcttctgttgatctcagtattgtcaggggaacagagaagttgggaaaagattactgaaatataccttttgcatttctttctagagtagctcccatatatggagatgggtgattctcttgatgccaccttcagatccttttattctccagaataattcttaacagtggttcaaatttcctttcataccttgaagtatgtgtttagtagcctcaattctccattaattaaaagtgtgggctgggcgtgggggctcatgcctgtaatcccagcactttgggaggccgaggtgggcagatcacctgaggtcaggagttcaagaccagcctggccaacatggtgaaaccccgtctctacaaaaatacaaaaattagccaggcgtgatggcaggtgcctgtaatcctagctacttggcaggctaacgcaggagaatcacttgaccgggagacagaggttgcagtgagctgagatcgtacctattgcactccatcctggatgaaagagccagactctgtctcaaaacaaacaaaaaagcgtggggacttctggggacagacaaggtgcctgttatatatttactcagtctttgccctgaatggtctcagcttgagaccatttcaaactggagagaagcaagccagccaatagaatggggtgatttacagggatttctgtttactgtcaaaatatttctcatctgcactatgtttccatttgtggtcctgaaggaaattcttataactcaacatttgtctggtcttataagtaaagacagctttaaaatc

SEQ ID NO: 198427 - DNA, 687 bp, Homo sapiens
  Payload ID: 19156
  Gene Name: uroplakin 1B
  ENST ID: ENST00000479520
  CDS Start-End: 180-687
ggagcgggccctaccgtgtgcgcagaaagaggaggcgctggacttatcctaccttaagttgaagcagaccagcaattgttgtgacctacaatctccacacccatctttactctgagccaaggaagtgtctgttcttgtgctgagtttcaggtgccttcagcttgtgggaaatcccgaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaa

SEQ ID NO: 198428 - DNA, 670 bp, Homo sapiens
  Payload ID: 19156
  Gene Name: uroplakin 1B
  ENST ID: ENST00000494855
  CDS Start-End: 103-670
ggagcgggccctaccgtgtgcgcagaaagaggaggcgctaaactgtagcagttatttggtaatgctttcaacagtgccttcagcttgtgggaaatcccgaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaat

SEQ ID NO: 198429 - DNA, 981 bp, Homo sapiens
  Payload ID: 19156
  Gene Name: uroplakin 1B
  ENST ID: ENST00000497685
  CDS Start-End: 294-836
aatcacagactacccttccctggtcctggaggttcaaagaattgcaggagggtagaaaagcacctgggtcgggtgcagactgcggagcgggccctaccgtgtgcgcagaaagaggaggcgcttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactttttgggttctcctgggtaccatgttctactggagcagaattgaatattaagcataaagtgttgccaccatacctccttccccgagtgactctggatttggtgctggaaccagctctctcctaatattccacgtttgtgccccacactaacgtgtgtgtcttacattgccaagtcagatggtacggacttccttta

SEQ ID NO: 198430 - DNA, 916 bp, Homo sapiens
  Payload ID: 19157
  Gene Name: uroplakin 2
  Uniprot ID: O00526
  ENST ID: ENST00000264031
  CDS Start-End: 36-590
agcctgccagcacctattccacctcccagcccagcatggcacccctgctgcccatccggaccttgcccttgatcctgattctgctggctctgctgtccccaggggctgcagacttcaacatctcaagcctctctggtctgctgtccccggcgctaacggagagcctgctggttgccttgcccccctgtcacctcacaggaggcaatgccacactgatggtccggagagccaatgacagcaaagtggtgacgtccagctttgtggtgcctccgtgccgtgggcgcagggaactggtgagtgtggtggacagtggtgctggcttcacagtcactcggctcagtgcataccaggtgacaaacctcgtgccaggaaccaaattctacatttcctacctagtgaagaaggggacagccactgagtccagcagagagatcccaatgtccacactccctcgaaggaacatggaatccattgggctgggtatggcccgcacagggggcatggtggtcatcacggtgctgctctctgtcgccatgttcctgctggtgctgggcttcatcattgccctggcactgggctcccgcaagtaaggaggtctgcccggagcagcagcttctccaggaagcccagggcaccatccagctccccagcccacctgctcccaggccccaggcctgtggctcccttggtgccctcgcctcctcctcctgccctcctctcccctagagccctctcctccctctgtccctctccttgcccccagtgcctcaccttccaacactccattattcctctcaccccactcctgtcagagttgactttcctcccattttaccactttaaacacccccataacaattcccccatccttcagtgaactaagtccctataataaaggctgaggctgcatctgcca

SEQ ID NO: 198431 - DNA, 1051 bp, Homo sapiens
  Payload ID: 19158
  Gene Name: uroplakin 3A
  Uniprot ID: O75631
  ENST ID: ENST00000216211
  CDS Start-End: 33-896
ccgccccgcgctctggcggctcctcccgggcgatgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagccatttccaggaatgcctcagtgcaagacagcaccaacaccccactgggctcaacgttcctacaaacagagggtgggaggacaggtccctacaaagctgtggcctttgacctgatcccctgcagtgacctgcccagcctggatgccattggggatgtgtccaaggcctcacagatcctgaatgcctacctggtcagggtgggtgccaacgggacctgcctgtgggatcccaacttccagggcctctgtaacgcacccctgtcggcagccacggagtacaggttcaagtatgtcctggtcaatatgtccacgggcttggtagaggaccagaccctgtggtcagaccccatccgcaccaaccagctcaccccatactcgacgatcgacacgtggccaggccggcggagcggaggcatgatcgtcatcacttccatcctgggctccctgcccttctttctacttgtgggttttgctggcgccattgccctcagcctcgtggacatggggagttctgatggggaaacgactcacgactcccaaatcactcaggaggctgttcccaagtcgctgggggcctcggagtcttcctacacgtccgtgaaccgggggccgccactggacagggctgaggtgtattccagcaagctccaagactgagcccagcaccacccctgggcagcagcatcctcctctctggccttgccccaggccctgcagcggtggttgtcacaccctgacttcagggaaggtgaaacagggcttgtccctccaactgcaggaaaacccttaataaaatcttctgatgagttcta

SEQ ID NO: 198432 - DNA, 627 bp, Homo sapiens
  Payload ID: 19158
  Gene Name: uroplakin 3A
  Uniprot ID: O75631
  ENST ID: ENST00000396082
  CDS Start-End: 24-524
gctctggcggctcctcccgggcgatgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagtcaccccatactcgacgatcgacacgtggccaggccggcggagcggaggcatgatcgtcatcacttccatcctgggctccctgcccttctttctacttgtgggttttgctggcgccattgccctcagcctcgtggacatggggagttctgatggggaaacgactcacgactcccaaatcactcaggaggctgttcccaagtcgctgggggcctcggagtcttcctacacgtccgtgaaccgggggccgccactggacagggctgaggtgtattccagcaagctccaagactgagcccagcaccacccctgggcagcagcatcctcctctctggccttgccccaggccctgcagcggtggttgtcacaccctgacttcagggaaggtgaaacagggc

SEQ ID NO: 198433 - DNA, 1296 bp, Homo sapiens
  Payload ID: 19159
  Gene Name: uroplakin 3B
  Uniprot ID: Q9BT76
  ENST ID: ENST00000257632
  CDS Start-End: 129-1091
tttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctgg

SEQ ID NO: 198434 - DNA, 2373 bp, Homo sapiens
  Payload ID: 19159
  Gene Name: uroplakin 3B
  Uniprot ID: Q9BT76
  ENST ID: ENST00000334348
  CDS Start-End: 226-1056
cagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggatacccagtccccacctccatccccacctctgtctcacctgacctcctgcgagggaggctggagactgtgtggacaggccgccctgaccgcaagcttccagaccctgggaggaggcctgcagaggactgtgctttgcctgatgcagggagctgggcccatcctggggcctatgagacctgagccaccctccgtcccccatcccacacatcagtggctgggcggggtgaggattcagaggcatctctactgcccctgggcacagcacctttctgagagtgggactctccatggtcatctgactaccaattctggccaccacctccaaccctcttgtgcatatggatggctctagcccttatccaccccctcaagcatttattaagcatctgctgtatgctacatacagtgttagacttggggcttcaggcatagccggtcctgaccttggggagatgccttctctagacctgagacgaccacgtgtccagatgtgacctgttgctgtcgggggtctatcaggcccttagaccgtcaccccagtaggctctccaggacccaggagcctccatcacctggaaggaccctctgtgcaaaacctcaagcgtccatctgtgcacaaggccggtggttcccgtcgtcgccactcggggtcgccggtgagccgcagccaggccgcctcacggccagtgtgcatgctcgctgctattcgctgccccttctgcctccgaggcggtagcagatgccacgttggcggggtcggtgaaggtcaggactctaggcctccctccgccaagccagagggatgagcaatcacgcctgagagcccactgcgtgccatgcagtccgcacagccgcagcggttttctagatggagaaactgaggctcagtgacttgcccgctgcactctgtccacggccgctgcacacgcccccttgggctgcgctcccggaccttctaatgtgaccacggctcccggcatgcaggccctgccagcggagggagcccggtggtgacccttggtctgcagccctctttggaggtgaataaatgcggtctggagccc

SEQ ID NO: 198435 - DNA, 1041 bp, Homo sapiens
  Payload ID: 19159
  Gene Name: uroplakin 3B
  Uniprot ID: Q9BT76
  ENST ID: ENST00000394849
  CDS Start-End: 39-836
agaccagcccctgagcctcccgggtgctggcagctgtcatggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctgg

SEQ ID NO: 198436 - DNA, 1516 bp, Homo sapiens
  Payload ID: 19159
  Gene Name: uroplakin 3B
  Uniprot ID: Q9BT76
  ENST ID: ENST00000448265
  CDS Start-End: 129-1091
tttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcattgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctggcctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaa

SEQ ID NO: 198437 - DNA, 1528 bp, Homo sapiens
  Payload ID: 19159
  Gene Name: uroplakin 3B
  Uniprot ID: Q9BT76
  ENST ID: ENST00000615976
  CDS Start-End: 226-1056
cagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcattgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctggcctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaa

SEQ ID NO: 198438 - DNA, 1041 bp, Homo sapiens
  Payload ID: 19159
  Gene Name: uroplakin 3B
  ENST ID: ENST00000631529
  CDS Start-End: 39-836
agaccagcccctgagcctcccgggtgctggcagctgtcatggggctaccctgggggcagcctcacctagggctgcagatgctcctcctggcattgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctggcctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctgg

SEQ ID NO: 198439 - DNA, 1342 bp, Homo sapiens
  Payload ID: 19160
  Gene Name: uroplakin 3B-like
  Uniprot ID: B0FP48
  ENST ID: ENST00000340457
  CDS Start-End: 51-842
gacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcggaaataaatgcccccaaaacctc

SEQ ID NO: 198440 - DNA, 1300 bp, Homo sapiens
  Payload ID: 19161
  Gene Name: uroporphyrinogen decarboxylase
  Uniprot ID: P06132
  ENST ID: ENST00000246337
  CDS Start-End: 120-1223
tgatcttcaacatggcgacgctcttggttccctacagaaaggggcggagcctggactggggggcaggctcagattcaggttaaattgtggattgagctcgcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 198441 - DNA, 682 bp, Homo sapiens
  Payload ID: 19161
  Gene Name: uroporphyrinogen decarboxylase
  ENST ID: ENST00000428106
  CDS Start-End: 1-682
acctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggcccca

SEQ ID NO: 198442 - DNA, 600 bp, Homo sapiens
  Payload ID: 19161
  Gene Name: uroporphyrinogen decarboxylase
  ENST ID: ENST00000434478
  CDS Start-End: 21-600
gcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgc

SEQ ID NO: 198443 - DNA, 744 bp, Homo sapiens
  Payload ID: 19162
  Gene Name: uroporphyrinogen III synthase
  ENST ID: ENST00000368774
  CDS Start-End: 88-489
accgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagtaagtagaaaaacatcactccaaatgaagccatttattttttgttgacctcacaaccactacctagggaaaagaatatttcctcagtgcattcttggtggtgagattgattggtgagcatcgtataacccactctgggagcatagcctatttgtatttgtgtatgtctatactttgtgaggtttagcccacttccttctaccccctgtaccaaagaacttgacttgaacataacacaaaataaaacatttgggagataaaaa

SEQ ID NO: 198444 - DNA, 1556 bp, Homo sapiens
  Payload ID: 19162
  Gene Name: uroporphyrinogen III synthase
  ENST ID: ENST00000368778
  CDS Start-End: 195-614
ctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagtgaagaagtcaaaggaatcttttgaagtgaagaaagtgggtttggacgtgcccttatgctgatgaatcattggagtaatatctggggtttagccgcatccttggtggcaaggcggtggggaaagcccctgagggtgaggccagcctgagccccaagggaaaggggctgctgggacctcctgacctcaactcatctccaggagcgcacagggcctcgcacagatgcctcagtctgtaccgctgggagttcgtgccatctcagacctaccctccctacctgggctgtacctaaagagatactgctaggctttctctagaatgtttcatgagccagcactgtgagacattttcaagctaaaaacatacagttcaggagactgtaatctgtggtagaaagtgttcaccatttgctgctagtaaagacggttggccctgtgcttctctggccacttgtgccacatggtgttctcggaagaggcctctccatgcaccagtgtggagaagccctctggaggccaattcaaagagcatctgaggctaagcaactgaaaggaaaaggcctgatggccaacgtgttgctttctgtggaatgttccagactggattgctgggggtcattttctttaacagcagcctagacaggcagtgactctcttttattcagccaggtgttgaaatagctgcagggaagccacagacagttgttccagctttccggatcagagagcactggttgggccccgtgccatgtggccccagccccatgggatcgctcctcaggtcatggagccacacatcagtgtggagggttcgctccaggggttcctggtacaggatgcagatgggtcttgtctggctccaggctttttgtttctaatgttgtttctagagagtcatcatcaccgcataaatggtatcaaagcccttcttttaaaaatgtagaaataaatgtaaatggtagatcttga

SEQ ID NO: 198445 - DNA, 1216 bp, Homo sapiens
  Payload ID: 19162
  Gene Name: uroporphyrinogen III synthase
  Uniprot ID: P10746
  ENST ID: ENST00000368786
  CDS Start-End: 134-931
ttccacaagcatttgattgccttcttcttgtgtaccgtccccatcggaaattgcttaggaagagtctttgagatctaattaagatctgtttccttgctctgtcgcagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgctt

SEQ ID NO: 198446 - DNA, 1313 bp, Homo sapiens
  Payload ID: 19162
  Gene Name: uroporphyrinogen III synthase
  Uniprot ID: P10746
  ENST ID: ENST00000368797
  CDS Start-End: 226-1023
cccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgcttactga

SEQ ID NO: 198447 - DNA, 802 bp, Homo sapiens
  Payload ID: 19162
  Gene Name: uroporphyrinogen III synthase
  ENST ID: ENST00000420761
  CDS Start-End: 247-802
gcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcaggctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtg

SEQ ID NO: 198448 - DNA, 3188 bp, Homo sapiens
  Payload ID: 19162
  Gene Name: uroporphyrinogen III synthase
  ENST ID: ENST00000462490
  CDS Start-End: 1-331
agaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagaaacacccttgaactggctccagagggactgaggagagggtgcaggatgtgacccagagcccaaggacagacactgccactcactgcagtcaggaagagcaaaaggcttcacctgccttctcacaggtgcatctcatgtggggagtatgcaccgctctcccagttttaaagatggagcacggggctcagagacatcatatggcctgtctgtaggtcacactgctgagaaggaagagctgcagttgaacctgggaagactgattccacattgtcagccatggtgatgccttgccatggtctcaggagctgctgagcagttgatgcacttctgggcagtaactgatacaattctcacaccagtccagtggtgggtatccagaaaaagaggtcagtgttcctcattacaggtgaggacactgagggctagagaggtgaaacaacttgccaaagtcatgttttgagttcctagaaggcccaggactcacacaggtcaccgaggaagaaaaacaatatctgaatcttgtggttagaaagattagagagaggccgggcgctgtggctcccacctggaatcccagcactttgggaggcctcaggcggatcacctgaggtcaggtgttccagaccagcctgtccaatatgatgaaaaccccgtctttactaaaaatataaaaattagctgggcatggtggcatgcgcctataatcccagctacatgggaggctgagacaggagaatcgcttgaaccctggagactgaggttgcagtgagccgagatcgcgccacggcactccagcctgggtgacaagagtgaaactccgtacctgccccataaaagaaaaaaagaaagaaaaagaaaaattaaagagataggacccataaagtgcttagcatggcaactggtccatatgaccagcgcttacgtcatattgcaggtcaggatgggtcacggtgctggtcctgctctggttcttgtccctctgtgccctgctgcctctcccctgggcctgtaggaggagtccccacctccaccccacccacccacccccaagtcacacaatgctgtgagatgcctggtggtataagcctaacacagttttccccaagcttcttagtgtttgcctagaggaagaacaaaagatttatactctatcttctttcaaagtgagcatatttaaaagcacaaatggatactcagcatctgaaccaagaactcaggcctttctgaatagactgctgcctgcattgtccacacccatggcagctgggggctgagtgcgtgttcctatcctgtatctgtcacacccatttctgcagccctccagacactctgaggagctctcagtagccccctcgcctcttactacagtgattgattaccctgcctgccagtagttaacacctctgccattgctgaggaggagaaagtgacagagctggccttgctcacagtgactatggactgcttgggggccacgaaggcactgtgtgtgggttgtgagttgtccctcgacactgggacttggcgctggatagtgaggtgctttcaaggttcacagaggacacagtcctagcccgtgagttggtagttaggcttttctgtctcagctcagcctcagatttgctactgtcctccctccccaggagtccctgtagggcccactgtttgtacagcattgcacaacatgcaggcgcaccacaaaagatcaaagggggtgacttccgacctgaacttgctacttatccattgacttgggaagaccacgcacttgtctataaatgccacagagatgtcactgcaaagcagtaggtaagcagattcgtaatcaccaccaccacactaatggcagcagctgaatttcctgtgtacagcaaaatgcccttgcagcctgtgaggtgggtatcttcacacctagtgctcactagccacagtggcagagccaggctgtgaacgtggctgctgcccccaaagccaggctggtgcactcacgtccagtttgtgccagggatggagaaagaacgttgatgctgggccccctcgcctggcctggggaagactgctgctctgtggggcagcatcatgtgagcattcattgacacaggagtgaaaggctcctgtgaaaaagctgctgtttcaccaaactgttgatacccctgctctaggactacagtcatgtttgccatttgctggttcccagtcccagggagtttctttttttcaaatttttaaatagctttattgagatgtaattcacaaaccataaaatttactttttatgattttaatatgtaaacttaaaaattttttttttatttttttagagatggggtctcactgtgttgcctaggctgatctcaaactcctggcctcaagtaatcttcccaccttggcctcccaaaatgtagggattacaggtgtgagccaccacgcccagcccaatatgtaaactttaacatgatttttatgagagtcacagatttgtgcaaccatcaccactgtctagttccaggacatatcatcaccccaaagagaaacccggtacccattcgcagccacccctcattccctcattcctcccactccttggcaaccactcaactgtttttcatctccatggatttacctattccggacatctcatattaatagaatcatacagtatgtggtcttttgtaactgactcttttcactagcatagtgttttcaaggttcatccatgctgtagctggtaccagtacttcatccctttttagtgccaaataatagtacatgctgaggaccgttttatttacccattcactagttgatggatatttggattgttttccactttcaggctattaaataatgctaaacattcaaatacaa

SEQ ID NO: 198449 - DNA, 441 bp, Homo sapiens
  Payload ID: 19162
  Gene Name: uroporphyrinogen III synthase
  ENST ID: ENST00000616800
  CDS Start-End: 1-205
gtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagatcgaagagctggagctccagtgggcatcttgggccctgagatgacattggggaaagaaagttttctggaacaaggtgacactgtgggcacaaaaactatcccaactctagacttcttgagtgtaaaagacatatcgacttctatcttgtttaagccactattactacgagattttttcttttacaatcaaatctaaatgataaaataatcaagtgaattggtagagtaaacatcaagataaaccgtttccgagtttgaataaaatgcccttttaagaaaa

SEQ ID NO: 198450 - DNA, 563 bp, Homo sapiens
  Payload ID: 19162
  Gene Name: uroporphyrinogen III synthase
  ENST ID: ENST00000622016
  CDS Start-End: 1-369
tttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagctcctggatggaggagagttgctgaagaagttcatgcagggaaggaataaaggatcacacaggaatttgagagccaaagtaaagtgcaactggccccccaggcccagaggggctagcagtgagaactgaagatgttccctctggaccttccggccacagctcattgatgggacatgttctcagacagtgttgtaagttttgtgtgctttaactcatgagttacacgtggtcactcacttaatgagttaagcgttaatacaacttccctgtgaatagaaggtaacaaaataaaaacattgtgttgtatacaagtcttcagaaaa

SEQ ID NO: 198451 - DNA, 420 bp, Homo sapiens
  Payload ID: 19163
  Gene Name: urotensin 2
  Uniprot ID: O95399
  ENST ID: ENST00000054668
  CDS Start-End: 1-420
atggaaaccaacgtatttcatcttatgctctgcgtcacttctgctcggactcataaatccacgtctctttgctttggccacttcaactcatatccaagccttcctttaattcatgatttattgctggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacgtgagactcctgattgcttctggaaatactgtgtctga

SEQ ID NO: 198452 - DNA, 559 bp, Homo sapiens
  Payload ID: 19163
  Gene Name: urotensin 2
  Uniprot ID: O95399
  ENST ID: ENST00000361696
  CDS Start-End: 33-407
ccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacgtgagactcctgattgcttctggaaatactgtgtctgaagtgaaataagcatctgttagtcagctcagaaacacccatcttagaatatgaaaaataacacaatgcttgatttgaaaacagtgtggagaaaaactaggcaaactacaccctgttcattgttacctggaaaataaatcctctatgttttgca

SEQ ID NO: 198453 - DNA, 1601 bp, Homo sapiens
  Payload ID: 19163
  Gene Name: urotensin 2
  ENST ID: ENST00000377516
  CDS Start-End: 322-741
tccacagattgtcattcttcagggatggcagccctaaacacagcatggcaactcatctactcactcatgaaagattaaaaaatggaaaccaacgtatttcatcttatgctctgcgtcacttctgctcggactcataaatccacgtctctttgctttggccacttcaactcatatccaagccttcctttaattcatgatttattgctgatgatgtcaggtcataggatgatatatataatcagtgagcaggcagaatgaggagacagttgaaagttctctacaacagaagccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacagagaagaaagctgaggcaagatttaagattgtggaagaaagagcctggcttacgaatttttaaaaactatgtgtgggtgtgaatttcatctatcattccaagtttaagaaggaatcagggacttctctaaaaagcaccagagagtgagctgatttatcaagtaaacaatcacactcacttcttaaaagacacaactacaaacgccatagaaagcggtgactgatggagcctgcaggaccctgtgggcgaggacaactgggctcgcctggacgttttctcttttgcagtccccacaacactgccctgttcaagggcaaacaaaaggcagtgccagtcagacctgtggtagggctggagcgacctcttttgtataaattgattggaaagaaagagttaactgttttggtaagaatgaaaatttaaacacagaagtatgtaagaatgatactagcttttacattacttgtaaaacattttacaatcattattttaaaaacaaaaatactcaaaagggcaacagcactgggtaagaagctctttcattttaatattacacatgcaaatgctaactgaaacttacaagaataggcccatggtaagcggatcgatttttaagataagactttcagaatttcactggaaggtgggaaatcaataggaaagggatctacaaggatgaaggccaaaactcaacccccaaaacctggttatcccagatatgctaatggacagtatgtgctaatgtgttgtgagaaaaccggaatgtttcatcttaattatggaggggaacgccaggttgaatgaagcctgtatgaacgtactacattcatggaaaccattatgaaaagtacacaacctgtaggtggcatttcttcaagcactctaaggggaaaatgacttatgtaacagaacaaaataaatgaggctaaggtttggggctca

SEQ ID NO: 198454 - DNA, 1357 bp, Homo sapiens
  Payload ID: 19164
  Gene Name: urotensin 2 receptor
  Uniprot ID: Q9UKP6
  ENST ID: ENST00000313135
  CDS Start-End: 96-1265
tctttccccacaggctgagctggttgcccacaggggcccccgccccatctcagggagtgtccacccagccctgagcccgtcgtgaggggtcagagatggcgctgacccccgagtccccgagcagcttccctgggctggccgccactggcagctctgtgccggagccgcctggcggccccaacgcaaccctcaacagctcctgggccagcccgaccgagcccagctccctggaggacctggtggccacgggcaccattgggactctgctgtcggccatgggcgtggtgggcgtggtgggcaacgcctacacgctggtggtcacctgccgctccctgcgtgcggtggcctccatgtacgtctacgtggtcaacctggcgctggccgacctgctgtacctgctcagcatccccttcatcgtggccacctacgtcaccaaggagtggcacttcggggacgtgggctgccgcgtgctcttcggcctggacttcctgaccatgcacgccagcatcttcacgctgaccgtcatgagcagcgagcgctacgctgcggtgctgcggccgctggacaccgtgcagcgccccaagggctaccgcaagctgctggcgctgggcacctggctgctggcgctgctgctgacgctgcccgtgatgctggccatgcggctggtgcgccggggtcccaagagcctgtgcctgcccgcctggggcccgcgcgcccaccgcgcctacctgacgctgctcttcgccaccagcatcgcggggcccgggctgctcatcgggctgctctacgcgcgcctggcccgcgcctaccgccgctcgcagcgcgcctccttcaagcgggcccggcggccgggggcgcgcgcgctgcgcctggtgctgggcatcgtgctgctcttctgggcctgcttcctgcccttctggctgtggcagctgctcgcccagtaccaccaggccccgctggcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccccgcgcccgcttccagcgctgttcgggccgctccctgtcttcctgcagcccacagcccactgacagcctcgtgctggccccagcggccccggcccgacctgcgcccgagggtcccagggccccggcgtgagcacgcggaggggcggctggagtccaggcggggacgcgccccaaagccccagccactcccgggagcccccccaactcccaaatcacaggccc

SEQ ID NO: 198455 - DNA, 2395 bp, Homo sapiens
  Payload ID: 19165
  Gene Name: urotensin 2B
  Uniprot ID: Q765I0
  ENST ID: ENST00000340524
  CDS Start-End: 788-1147
aactcaaggcataaggcgatccagcacctaagatctcagcaaaaaaaagctaggtcctgaggcagctagtggaaaaacaagagaagggaagtcaaaaggctacttgctgtcagctaaagccagacaacctctcctgtttcatctcctggcaacagaatgcatcctccttttgggaaactgcctctttccccactcctcagagtaaatcttgctgctgctcactctttgggtctgcactgcccataagagctgtagcactcaccgcgaaggtctgcagcttcactcttgaaaccagagagaccacgaacctaccgggagaaatgaacaaattccggacgcaccatctttaagaactgtaacactcactgcgaggatctgcggcttcattctttaagtctgtgagaccaagaacccaccaattccggcacactaatatgctgttggaaactggctatatggaaaggctatgtggaagaaaacaaacaccccagccaacataatggagctcccagctgacagctgacatctagctgattgccaaccactttggaaactgatcttcaaaacccacttgagctatgtcaagagaagccacctgtgacacagaagcagaaggatccaagtcaaaggagtttatttgggaggaaatagcacgagagaatgatcattcgtaactgaggcacacttgccttttgcaactaagctctactgaattccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggaaatgaaatatttccagataaaaaatatacaaatcgtgaggaactattgctggctctactgaataaaaattttgatttccaaagacctttcaacactgacctagccttacctaacaaactggaagaacttaaccagctggaaaagctaaaagaacagctagtggaggagaaggattctgagacgtcctatgctgtagatggtctattctcttctcatcctagcaaacgagcttgcttttggaaatactgtgtttaaagctttttctctggatgcaaaaaaagataagaatatcaggaaaatatatgtatctactcactctgctgtaggcagaccccctgaaactattgctgtggaataaaagatgaaatgctcctgattattgtaaatacaaaattgcatgcgggattgtgtaaagacaatgccaggttggactgccagaatgagccaacagcacttgcttccccctgtagagagcctatgaatggacgtgcagtcagggaggtttcatatcaccaagattcctatcccagaaaagcagatgttcatagctctgggaatggaatgcgcccctcgtggagagcctataaacggatgcatggaaggcgcctgtccatatggataagatagggttgtaaacgtcctcatcttgccatggctcttctaggcctctttagggttaaggcatatttccttctgagaatttctggtctaagcggttgtctagcttcatgtcctgtttccatggattgtttgtaaccagcttttgttacaattgttactgctgattaatatcttgctaatcataggttatggaaagattgtgtttctgttttaaggctctgttagaaattacacacacagtatattgtaaattcttatctctgtatactgtacttctacatacaaatgtactgtacttctacatacaaatgttatgttaaagaattacttcatccccatgtgaccatctcacctcataatcaaatgaccctaaatccctcattaacctacccctgcccttgctaaacttaataataaatgctggtatatccagtgcattgttggcaccatgggaccagaaggtggtgacccccctggacccagctttcactatcttgtgtgtgtctgttatttctcaacctgctgatccgcctgggaacaaagagccccgttgcattgcgggctactggccagatcccgcaatactctgctatttaaaattgtagctgtttcaatcataaagaaactggcatttattatgcatatgattttttcaccttgttcttgttactaagtcaattatgataagcttaaggtttatgttgtgaataatcactaatcagttgcacttttgaaggtatgtcactatcaaaatggttttgtagagctagagttgaaaatgctgtatctattgtatgctttccataaattcattgcttatgtaaagttttgtcctgttgtgactatgctgttgaactattaattaaaacattttgaaaagca

SEQ ID NO: 198456 - DNA, 839 bp, Homo sapiens
  Payload ID: 19165
  Gene Name: urotensin 2B
  ENST ID: ENST00000440476
  CDS Start-End: 143-388
tctttttccttcatctagatcattcgtaactgaggcacacttgccttttgcaactaagctctactgaattccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggaaatgaaatatttccagataaaaaatatacaaatcgtgaggaactattgctggctctactgaataaaaattttgatttccaaagacctttcaacactgctggaaaagctaaaagaacagctagtggaggagaaggattctgagacgtcctatgctgtagatggtctattctcttctcatcctagcaaacgagcttgcttttggaaatactgtgtttaaagctttttctctggatgcaaaaaaagataagaatatcaggaaaatatatgtatctactcactctgctgtaggcagaccccctgaaactattgctgtggaataaaagatgaaatgctcctgattattgtaaatacaaaattgcatgcgggattgtgtaaagacaatgccaggttggactgccagaatgagccaacagcacttgcttccccctgtagagagcctatgaatggacgtgcagtcagggaggtttcatatcaccaagattcctatcccagaaaagcagatgttcatagctctgggaatggaatgcgcccctcgtggagagcctataaacggatgcatggaaggcgcctgtccatatggataagatagggt

SEQ ID NO: 198457 - DNA, 676 bp, Homo sapiens
  Payload ID: 19165
  Gene Name: urotensin 2B
  Uniprot ID: Q765I0
  ENST ID: ENST00000427544
  CDS Start-End: 215-574
gtcacttctccaagtagtgaatcatgttaactacttgattgcattgcattttatagatttattttctttctttctttttccttcatctagatcattcgtaactgaggcacacttgccttttgcaactaagctctactgaattccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggaaatgaaatatttccagataaaaaatatacaaatcgtgaggaactattgctggctctactgaataaaaattttgatttccaaagacctttcaacactgacctagccttacctaacaaactggaagaacttaaccagctggaaaagctaaaagaacagctagtggaggagaaggattctgagacgtcctatgctgtagatggtctattctcttctcatcctagcaaacgagcttgcttttggaaatactgtgtttaaagctttttctctggatgcaaaaaaagataagaatatcaggaaaatatatgtatctactcactctgctgtaggcagaccccctgaaactattgctgtggaata

SEQ ID NO: 198458 - DNA, 1005 bp, Homo sapiens
  Payload ID: 19165
  Gene Name: urotensin 2B
  ENST ID: ENST00000432514
  CDS Start-End: 892-1005
agctagtggaaaaacaagagaagggaagtcaaaaggctacttgctgtcagctaaagccagacaacctctcctgtttcatctcctggcaacagaatgcatcctccttttgggaaactgcctctttccccactcctcagagtaaatcttgctgctgctcactctttgggtctgcactgcccataagagctgtagcactcaccgcgaaggtctgcagcttcactcttgaaaccagagagaccacgaacctaccgggagaaatgaacaaattccggacgcaccatctttaagaactgtaacactcactgcgaggatctgcggcttcattctttaagtctgtgagaccaagaacccaccaattccggcacactaatatgctgttggaaactggctatatggaaaggctatgtggaagaaaacaaacaccccagccaacataatggagctcccagctgacagctgacatctagctgattgccaaccactttggaaactgatcttcaaaacccacttgagctatgtcaagagaagccacctgtgacacagaagcagaaggatccaagtcaaaggagtttatttgggaggaaatagcacgagagaatgtgatacttgggaaaattatgtagagagagagattaaagatgcaagctataaaaggaattgataatataaaagctcctgagaagattggaagaatacatataagagaccctgatccttgataggatggaccttttctagaactaccatcaccctggaagctgaagaaaatcattcgtaactgaggcacacttgccttttgcaactaagctctactgaattccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggaaatgaaata

SEQ ID NO: 198459 - DNA, 701 bp, Homo sapiens
  Payload ID: 19165
  Gene Name: urotensin 2B
  ENST ID: ENST00000425357
  CDS Start-End: 122-367
attcgtaactgaggcacacttgccttttgcaactaagctctactgaattccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggaaatgaaatatttccagataaaaaatatacaaatcgtgaggaactattgctggctctactgaataaaaattttgatttccaaagacctttcaacactgctggaaaagctaaaagaacagctagtggaggagaaggattctgagacgtcctatgctgtagatggtctattctcttctcatcctagcaaacgagccctatcatccagaacgttgatacagcttaactgcctccaacattgccaaaacagaagaggataaaggatacatcccagctttcaattgcctcagttcggaagggacacacatcatttctactgaagtccattggccgggattagtcactgggactaccaccaacatatggcaaggcagcttgcttttggaaatactgtgtttaaagctttttctctggatgcaaaaaaagataagaatatcaggaaaatatatgtatctactcactctgctgtaggcagaccc

SEQ ID NO: 198460 - DNA, 836 bp, Homo sapiens
  Payload ID: 19165
  Gene Name: urotensin 2B
  ENST ID: ENST00000446788
  CDS Start-End: 73-471
ccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggaaatgaaatatttccagataaaaaatatacaaatcgtgaggaactattgctggctctactgaataaaaattttgatttccaaagacctttcaacactgacctagccttacctaacaaactggaagaacttaaccagctggaaaagctaaaagaacagctagtggaggagaaggattctgagacgtcctatgctgtagatggtctattctcttctcatcctagcaaacgagccctatcatccagaacgttgatacagcttaactgcctccaacattgccaaaacagaagaggataaaggatacatcccagctttcaattgcctcagttcggaagggacacacatcatttctactgaagtccattggccgggattagtcactgggactaccaccaacatatggcaaggcagcttgcttttggaaatactgtgtttaaagctttttctctggatgcaaaaaaagataagaatatcaggaaaatatatgtatctactcactctgctgtaggcagaccccctgaaactattgctgtggaataaaagatgaaatgctcctgattattgtaaatacaaaattgcatgcgggattgtgtaaagacaatgccaggttggactgccagaatgagccaacagcacttgcttccccctgtagagagcctatg

SEQ ID NO: 198461 - DNA, 2700 bp, Homo sapiens
  Payload ID: 19166
  Gene Name: Usher syndrome 1C
  Uniprot ID: Q9Y6N9
  ENST ID: ENST00000005226
  CDS Start-End: 1-2700
atggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtcttttggatggttttatcgttacgatggcaaattcccaaccatccggaagaaaggaaaagataagaagaaagccaagtatggcagcctgcaggacttgagaaagaataagaaagaactggagtttgagcaaaagctttacaaagagaaagaggaaatgctggagaaggaaaagcagctaaagatcaaccggctggcccaggaggtgtctgagacagagcgggaagaccttgaagaatcggaaaagattcaatattgggtggagaggctctgtcaaacgcgcctcgagcagatttcctctgctgataatgagatttcagagatgaccacagggcccccgcctcccccgccttctgtgtctcccctggccccacccttgagacgcttcgcaggcggactgcacctgcacaccactgacctggacgacatccctttggacatgttctactatccccccaagactccctctgccttgcctgtgatgccccaccctccaccctccaacccaccccacaaggtcccggcgccccctgtccttcccttatctggccatgtgagcgcctcatcctctccatgggtgcagcgcactccaccccccattcccatccctcccccgccatccgttcccacccaagacctcactcccacccgcccactgccctcggcgctggaagaagcactgagcaaccatcccttccgcactggggacacaggcaatccagtggaggactgggaggcaaagaaccacagtgggaagcccactaactcccctgtccctgaacagagcttcccacccaccccaaagacattttgcccaagcccacagcctccacgaggccctggcgtgtccaccatctccaaacctgtcatggtccaccaggagcccaatttcatctacaggccagctgtgaaatctgaagttctgccacaggagatgttgaagaggatggtggtttatcagacagcattcagacaagatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgaggctgccctgcagaaggcctggaatcagggcggggactggatcgaccttgtggttgccgtctgccccccaaaggagtatgacgatgagctagcttctcttccctcctccgtagctgaaagcccccaaccggtccgaaagctccttgaagaccgtgctgccgtgcacagacacgggttcctcctgcagctggagcccacggaccttcttctgaagtccaaaaggggaaaccaaattcaccgttag

SEQ ID NO: 198462 - DNA, 2237 bp, Homo sapiens
  Payload ID: 19166
  Gene Name: Usher syndrome 1C
  Uniprot ID: Q9Y6N9
  ENST ID: ENST00000318024
  CDS Start-End: 110-1768
agctccgagggcggctggcccggtcgcggtcgcggctctttccagctcctggcagccgggcacccgaaggaacgggtcgtgcaacgacgcagctggacctggcccagccatggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgaggctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggatcagccttgagagaggccacactacacacaccagatggcatccttgggacctgaatctatcacccaggaatctcaaactccctttggccctgaaccagggccagataaggaacagctcgggccactcttctgaaggccaacgtggaggaaagggagcagccagccatttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaatagatttattttccagctta

SEQ ID NO: 198463 - DNA, 2149 bp, Homo sapiens
  Payload ID: 19166
  Gene Name: Usher syndrome 1C
  Uniprot ID: Q9Y6N9
  ENST ID: ENST00000526313
  CDS Start-End: 96-1307
ctggcccggtcgcggtcgcggctctttccagctcctggcagccgggcacccgaaggaacgggtcgtgcaacgacgcagctggacctggcccagccatggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtgatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgaggctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggatcagccttgagagaggccacactacacacaccagatggcatccttgggacctgaatctatcacccaggaatctcaaactccctttggccctgaaccagggccagataaggaacagctcgggccactcttctgaaggccaacgtggaggaaagggagcagccagccatttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaatagatttattttccagctta

SEQ ID NO: 198464 - DNA, 2278 bp, Homo sapiens
  Payload ID: 19166
  Gene Name: Usher syndrome 1C
  Uniprot ID: Q9Y6N9
  ENST ID: ENST00000527720
  CDS Start-End: 246-1811
gtggtctgcataggtctgatgcattggggtcagaggggcagcctggcctgtggctcctcttctctcctcacaactccagccctgaaaagctgctggggaggcccttggggatgacctctcctccctgaggtctgctatgggggcgggtgctgagcctggagctgtgattctgctattggattttccaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgaggctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggatcagccttgagagaggccacactacacacaccagatggcatccttgggacctgaatctatcacccaggaatctcaaactccctttggccctgaaccagggccagataaggaacagctcgggccactcttctgaaggccaacgtggaggaaagggagcagccagccatttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaatagatttattttccagct

SEQ ID NO: 198465 - DNA, 2159 bp, Homo sapiens
  Payload ID: 19166
  Gene Name: Usher syndrome 1C
  Uniprot ID: Q9Y6N9
  ENST ID: ENST00000527020
  CDS Start-End: 94-1695
ggcccggtcgcggtcgcggctctttccagctcctggcagccgggcacccgaaggaacgggtcgtgcaacgacgcagctggacctggcccagccatggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggagggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgaggctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggatcagccttgagagaggccacactacacacaccagatggcatccttgggacctgaatctatcacccaggaatctcaaactccctttggccctgaaccagggccagataaggaacagctcgggccactcttctgaaggccaacgtggaggaaagggagcagccagccatttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaatagatttattttcca

SEQ ID NO: 198466 - DNA, 1040 bp, Homo sapiens
  Payload ID: 19166
  Gene Name: Usher syndrome 1C
  ENST ID: ENST00000526181
  CDS Start-End: 88-1040
agctaaggtcaggacaagacagagtgaaggtcccctggcactgatgttacagaagaattcggtggtaaggggcttctggagagtggcatgtgctatctaagcgagtggcccaaatccttcctgaaagcatttatccggcactacagccaccatcaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggc

SEQ ID NO: 198467 - DNA, 3335 bp, Homo sapiens
  Payload ID: 19167
  Gene Name: Usher syndrome 1C binding protein 1
  Uniprot ID: Q8N6Y0
  ENST ID: ENST00000252597
  CDS Start-End: 175-2286
gtttcccagcccctcccaggccaggcttggccagcccaggcctgaacaggcagtggtcagagtgaccccaacagagtgtcccgggactcaggcctctgatcaagttacccccagaggatcagagaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggcagccagtgggagctccaagcccagctttgccccacctccggtgagctccgggctggagcagctgggccccatggaggaggtcagtggccaaggcctaggaagcaggactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagtgaacactgtgaagaggcatacagggttctgcttgctctgcgggaggccgactcaggagcaggagacgaagcccccatgagtgacctgcaagcagctgaaaaggaagcatggaggctgctggcacaagaggaggctgccatggatgcaggagcacagcagaatccacagccaagccctgaaggcagcagtgtggataagcccaccccacaggaagtggctttccagctccgaagctatgtccagcgtctccaggagcgccgttctctaatgaagattctctcagagcctggccccaccttggcacccatgcccactgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtgacatcatgtcatgttgcatgatttggcatgttggggcacatttggcgtgagggaagctggtgcacatgggtgtccagggcctgatggggtgtggccaggcaatgaagaaagactcaggtgtctttggcctggcaccaagtggaatgtgaacttcatatcagtggggtcaggccagaagcaacctgggctatgggaccaggtccctgggactgacgcatttcgggggtccgtgaggttgcatagccacagctgaagttccaactggcctgtctcccgaagcccagggagggattcatggggactggacagagcttctcctggcagccccttcccagggagatgctgggtttggctggcagattttcctgaagggggccgggctcagtggtgcacatctgtaatcccagcattttgggaggccaaggtgggtagatcacttgagcccaggagttcaagaccagcctgggcaacatggcaaaaccccatttctacaaaaaaatacaaaaattagccaggcgtggtggcatgtgcctataaagatatttaggaggctaaagtgggagggtaacttgagcttgggaagtggaggttgcagtgagctgagatcacgccactgcactccagtctgggtcacagagtaagaccttgtctcaaaaaaaaaaacaggccaggcgtggtgactcatgcctgtaatcccagcactttgggaggctgaggcggggaggatcacctgaggtcaggagcttgagaccagcttggccaacatggtgaaacccccgtctctactaaaaatacaaaaattggctgggtgttgtggcacatgcctgtaatcccggctactcgggagactgaggcaggataattgcttgaacctgagaggcgggggttgcagtgaaccgagatcgcgccaacaacaagatcgtgcccgggcaataagagcaaaactctgtctctaaataaataaataaaacacaaaacaaaac

SEQ ID NO: 198468 - DNA, 2402 bp, Homo sapiens
  Payload ID: 19167
  Gene Name: Usher syndrome 1C binding protein 1
  ENST ID: ENST00000324554
  CDS Start-End: 107-1258
caacagagtgtcccgggactcaggcctctgatcaagttacccccagaggatcagagaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggcagccagtgggagctccaagcccagctttgccccacctccggtgagctccgggctggagcagctgggccccatggaggaggtcagtggccaaggcctaggaagcaggactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagagtcttgctctgtcacccaggctggagtgcagtggtgccatcttggctcactgcaacctccgcctccccagttcaagtgattctcctgcctcagcctcctgagtagctggaactacagtgaacactgtgaagaggcatacagggttctgcttgctctgcgggaggccgactcaggagcaggagacgaagcccccatgagtgacctgcaagcagctgaaaaggaagcatggaggctgctggcacaagaggaggctgccatggatgcaggagcacagcagaatccacagccaagccctgaaggcagcagtgtggataagcccaccccacaggaagtggctttccagctccgaagctatgtccagcgtctccaggagcgccgttctctaatgaagattctctcagagcctggccccaccttggcacccatgcccactgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtg

SEQ ID NO: 198469 - DNA, 2136 bp, Homo sapiens
  Payload ID: 19167
  Gene Name: Usher syndrome 1C binding protein 1
  ENST ID: ENST00000431146
  CDS Start-End: 146-2065
agagtgtcccgggactcaggcctctgatcaagttacccccagaggatcagagaggggttgacgaaggagaagcattcagagggcactggcttctggacagcaatgagtgcccgggccacgcggccccgaagccggcgagggaggcatgctccacccgactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagtgaacactgtgaagaggcatacagggttctgcttgctctgcgggaggccgactcaggagcaggagacgaagcccccatgagtgacctgcaagcagctgaaaaggaagcatggaggctgctggcacaagaggaggctgccatggatgcaggagcacagcagaatccacagccaagccctgaaggcagcagtgtggataagcccaccccacaggaagtggctttccagctccgaagctatgtccagcgtctccaggagcgccgttctctaatgaagattctctcagagcctggccccaccttggcacccatgcccactgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtgacatc

SEQ ID NO: 198470 - DNA, 3598 bp, Homo sapiens
  Payload ID: 19167
  Gene Name: Usher syndrome 1C binding protein 1
  Uniprot ID: Q8N6Y0
  ENST ID: ENST00000597928
  CDS Start-End: 93-299
gggactcaggcctctgatcaagttacccccagaggatcagagaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggcagccagtgggagctccaagcccagctttgccccacctccggtgagctccgggctggagcagctgggccccatggaggaggtcagtggccaaggcctaggaagcaggtaagacccgcttggtctgtgcccttcactccagtccagacgcatctttgccatccacagatctgctgatgtgcctgctctgctcacacacctaccatagctccctattgccttcagcctgactttcttttttttttgagtcttgctgtgtcacccaggctgtagtgcagtgcagtggcacaatctcggctcacagcaacccctgcctcccggttcaagcgggagcctcagcttcctgagtagttgggattacaggtgtgcgccaccacatccggctaagttttgcatttttagtgagacaggccacattagccaggctggtcttgaactcctgcccttaagtgatcccccaactttggcctccaaaagtgctgggattacaagtgtaagccgccgccccagaagaccctatttccagaaacttctgtctctcaccttcaggcctttcccagtgcccgtcacagtccaacttcactctgtttctcagctccaggtctcccctccaacttcttcaccacctctatctagcctcttccttgaattcacagcctcccagtctcaccctgggatgccagtcccagaacacgcagctcttgccaactccctgctccgctcacacctccccaagaccatgaagtttaagccctcagaattccctgcccagggccgagcatggtggctcatgcctataatcccagcactttgggaggccgagttgggcggatcacctgaggtcaggagtttgacaccagcctagccaacatggtgaaaccctgtctctactaaaaatacaaaaattagccaggcgtggtggtgggagcctgtaatcccagctacttgggggaccgaggcaggagaatcacttgaacccaggaggtggaggttgcagtgagccgagatcgcgccactgcactccaggctgggcaacagagtgagactccgtctcaaaaaataaaaaagaattccttgcccagcatggagtgactcaagtgcctgagttggtgtccacaggactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagagtcttgctctgtcacccaggctggagtgcagtggtgccatcttggctcactgcaacctccgcctccccagttcaagtgattctcctgcctcagcctcctgagtagctggaactacaggtgcgtaccaccacaccttgctaatctttgtctttttagtagagacggggtttcaccatgttggtcaggctggtctcgaactcctgacctcaggtaatcctcccgcctcagcctcccaaagtgctgggactacaggtgagggccattgcacccagccgagctgagtgtcctgaagcactcagaaccagtgtcccacagtgaacactgtgaagaggcatacagggttctgcttgctctgcgggaggccgactcaggagcaggagacgaagcccccatgagtgacctgcaagcagctgaaaaggaagcatggaggctgctggcacaagaggaggctgccatggatgcaggagcacagcagaatccacagccaagccctgaaggcagcagtgtggataagcccaccccacaggaagtggctttccagctccgaagctatgtccagcgtctccaggagcgccgttctctaatgaagattctctcagagcctggccccaccttggcacccatgcccactgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtga

SEQ ID NO: 198471 - DNA, 549 bp, Homo sapiens
  Payload ID: 19167
  Gene Name: Usher syndrome 1C binding protein 1
  ENST ID: ENST00000598309
  CDS Start-End: 452-549
ctttgcccgcgcagtgcctcccaacctggtcgcgcagcgccgggtccgctccttggctcagcagcagctccaggccgcggcggcagccccacgcggcggccacatgcagcggcgtcagtgcctcgacagatctggggcggcagcgcaagaggggtcattgcggactcagcctcccggcaggaaccccgatctccgctctggggacctggagccttcgttctcggcctcccggatctccgccgtccaccctgacggagtctcactctgtctcccaggctggagtacagtggcaagatctcagctcactgcaacctccgcctcccggactcaagtgattcttgtgcctcagcctcgcaagtcgctgggattataggcatggaccaccatgcccggaccaaatcaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggc

SEQ ID NO: 198472 - DNA, 577 bp, Homo sapiens
  Payload ID: 19167
  Gene Name: Usher syndrome 1C binding protein 1
  ENST ID: ENST00000594190
  CDS Start-End: 213-577
agagtgtcccgggactcaggcctctgatcaagttacccccagaggatcagagaggtagagagagctgaacctctcatttaggagggccggggaggagagggaattcttgagatcgcattcccaggctcaaatagaggaggaaagtggacaaagacgtagtgaaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggcagccagtgggagctccaagcccagctttgccccacctccggtgagctccgggctggagcagctgggccccatggaggaggtcagtggccaaggcctaggaagcaggactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccct

SEQ ID NO: 198473 - DNA, 1673 bp, Homo sapiens
  Payload ID: 19168
  Gene Name: Usher syndrome 1G (autosomal recessive)
  ENST ID: ENST00000579243
  CDS Start-End: 184-531
cagatgtcttggtagtcgcggctctggcgctccgcaccctccgtctgcggcagcgggggctggcggccccggcccctgcccggccccgtcctccaacctcatgcctcagccctaataccgccgccctcccctgcggggggcctttctccgtgtcccccgcccgccccgtccacttcgggcgccatgaacgaccagtaccaccgggcagcccgggatggctacctggagctcctcaaggaggccacccgaaaggagctgaatgcccccgacgaggatggcatgacccccactctctgggctgcctaccatggcaacctcgagtcgctgcgtctcattgtgagccgcggcttccaatggccacttgcactgcctgtccttcctggtgtccttcggagccaacatctggtgcctagacaacgactaccacacgccgctggacatggctgccatgaagggccacatggaatgcgtgcgctacctggactccatcgcggccaagcagagcagcctcaaccccaagctggtgggtaagctgaaggacaaggccttccgcgaggcggagcggcgcatccgcgagtgcgccaagctgcagcggaggcaccacgaacgcatggagcggcgataccggcgcgagctggccgagcgttccgacaccctcagcttctccagcctcacgtccagcaccctgagccgccggctgcagcatctggcgctgggcagccacctgccgtactctcaggccacgctgcacggcacggccaggggcaagaccaagatgcagaagaagctggagcggcgcaagcagggcggcgaaggcaccttcaaggtctccgaggatgggcgcaagagcgcccgctcgctctcgggcctgcagctgggcagcgacgtgatgttcgtgcgccagggcacctacgccaatcccaaggagtggggccgagccccgctccgggacatgttcctctcggacgaggacagcgtctcccgtgccacgctggcggccgagcctgcccactcggaggtcagcaccgactcaggccacgactccctgtttacccgccccggcctgggcaccatggtgttccgcagaaattacttgagcagtgggctgcacggactgggccgcgaggatgggggtctggatggggtgggagcgccgcggggtcggctgcagagctcccccagcctggacgatgacagcctgggcagtgccaacagcctgcaggaccgcagctgtggggaggagctgccctgggatgagctcgatttaggcttggacgaggacctggagcccgagactagcccgctggagaccttcctggcctctctgcacatggaggactttgccgccctcctgcggcaggagaagatcgacctcgaggctttgatgctgtgctctgacctcgacctccgcagcatcagcgtcccactggggccccgaaagaagatcttgggggccgtgaggaggcggcggcaggcgatggagcgcccgccggccctggaggacacagagctataaccgggggctcctctccccagaccaaaatgaattgcaagttgccacaacctatggtggggtctcgaggtcctcacagttgccagccctgcagcccccttccccaggagcaaggaccagttggggcgactcctttgaaagtctgtctgcaccttgaagc

SEQ ID NO: 198474 - DNA, 3558 bp, Homo sapiens
  Payload ID: 19168
  Gene Name: Usher syndrome 1G (autosomal recessive)
  Uniprot ID: Q495M9
  ENST ID: ENST00000614341
  CDS Start-End: 184-1569
cagatgtcttggtagtcgcggctctggcgctccgcaccctccgtctgcggcagcgggggctggcggccccggcccctgcccggccccgtcctccaacctcatgcctcagccctaataccgccgccctcccctgcggggggcctttctccgtgtcccccgcccgccccgtccacttcgggcgccatgaacgaccagtaccaccgggcagcccgggatggctacctggagctcctcaaggaggccacccgaaaggagctgaatgcccccgacgaggatggcatgacccccactctctgggctgcctaccatggcaacctcgagtcgctgcgtctcattgtgagccgcgggggtgacccggacaagtgtgacatctggggcaacacacccctgcatctggcagcttccaatggccacttgcactgcctgtccttcctggtgtccttcggagccaacatctggtgcctagacaacgactaccacacgccgctggacatggctgccatgaagggccacatggaatgcgtgcgctacctggactccatcgcggccaagcagagcagcctcaaccccaagctggtgggtaagctgaaggacaaggccttccgcgaggcggagcggcgcatccgcgagtgcgccaagctgcagcggaggcaccacgaacgcatggagcggcgataccggcgcgagctggccgagcgttccgacaccctcagcttctccagcctcacgtccagcaccctgagccgccggctgcagcatctggcgctgggcagccacctgccgtactctcaggccacgctgcacggcacggccaggggcaagaccaagatgcagaagaagctggagcggcgcaagcagggcggcgaaggcaccttcaaggtctccgaggatgggcgcaagagcgcccgctcgctctcgggcctgcagctgggcagcgacgtgatgttcgtgcgccagggcacctacgccaatcccaaggagtggggccgagccccgctccgggacatgttcctctcggacgaggacagcgtctcccgtgccacgctggcggccgagcctgcccactcggaggtcagcaccgactcaggccacgactccctgtttacccgccccggcctgggcaccatggtgttccgcagaaattacttgagcagtgggctgcacggactgggccgcgaggatgggggtctggatggggtgggagcgccgcggggtcggctgcagagctcccccagcctggacgatgacagcctgggcagtgccaacagcctgcaggaccgcagctgtggggaggagctgccctgggatgagctcgatttaggcttggacgaggacctggagcccgagactagcccgctggagaccttcctggcctctctgcacatggaggactttgccgccctcctgcggcaggagaagatcgacctcgaggctttgatgctgtgctctgacctcgacctccgcagcatcagcgtcccactggggccccgaaagaagatcttgggggccgtgaggaggcggcggcaggcgatggagcgcccgccggccctggaggacacagagctataaccgggggctcctctccccagaccaaaatgaattgcaagttgccacaacctatggtggggtctcgaggtcctcacagttgccagccctgcagcccccttccccaggagcaaggaccagttggggcgactcctttgaaagtctgtctgcaccttgaagctgagggtgtggcctggaggcaccagaggggcaagagaatgttccggaactccagttctgaggggtcttgaaggccctgagccacccattctgagcagccgtaaaggacatgtagacttgggggaggcctgccccagagggagggcaggggcatcggaactggatgagagtgtgggaggtggatgcgggagggtgcacctgtcccgggcgccgtggcctctcccacccctcccctgatggtcttgttctcttgtgctcaggccagagacttgctcacttcctgcattgttgtgaagggaagagtttgggctgcctcccctcctcccgtccaccccagaggggaagttcctcagccagactcttcagccaaatgccccaactttcagtctgtaccccatcccaagcatagccagctccccctccttcacctagtggtcaaggcccggagctggaaagccgggttggggtggggtgggggtactgacgcccttcccagctcatccaggggtggagcctggcctgtcttcctccaacctccccctttttcgttgtgcagcctggccccccagggaccccagagggccagggcgctagatgcaaggtgctagaccaatgggctgcagtattatagcccccaggcctggcaggcatgcgctgggctagagaaaggtgtccgccaacctcctcagtctcccaggcctgggacaggcagaacagggtgtggctgggtgtcaggcctggggtgggtaagtcctgcgatgtggacactggagaaagtggatcctctaaactgcagattgtccccaggtcaccagggctgtgtgcgtgtgcatgtttgtgtgcatgtatgcgtgtgtgcatgcatgtgtgtgtaagtatgtggtatgtgtgagcacgggtgtgtgcttgggtgtgtgtgttcttgcatacatgtgtgcgtgtgtgtgcacgtgaacgcgtgcgtgtttgtgtgtgtgcatgcatgtgtgtgcatgtgtgtgtgtgcatgcatgtgtgtgtgtgtgcatgtgtgcgtgtgtgcacactcacgttgggtggtgtttggtaggtttccctccaggtctggtagggactgggctgttgcgtgattctgcgtggatcgggggtaagagagctcacctgtgtcccagccctctgatggtggtgagaccaggggaaaggccagctcagagggtggtcacagcatgtgtcctctgacgtatgcccccaaagctctccagccagactgaggtcacagatgtgggagagtccctgatgagcccgctgacacgtgtgcgcccctttgcaccccatgcagaggtgctctcctcctttctcagccatggccccccatccctgacctcagcttgggaagcagctcctgctgggagcatggcctcagcccccagcatctcctggggcccccatggctggggcaggggaaagagagccctcaaaggcctctttctggtctgtctgggggttcccattcccacacatgtgcccagagtagggggcatggaggagatggtccctgtcctactgcaggacactgagggcttggctgcctgccaccgccatctggagcccaccacagctcttctccctgttctctgggcctgagcctggggccacccccaagtgccgacttgtttctcccagagccccaggtgctgccccttctctcctgttcctcgtccgtttactgccgcagcccctcctggttcttctggtgctggggtggagcaggctctgtgctcccaccactgtaccccgaatccctcctgcaggctcattgccacttttgtagagaatgttctctatcagtatcgt

SEQ ID NO: 198475 - DNA, 18883 bp, Homo sapiens
  Payload ID: 19169
  Gene Name: Usher syndrome 2A (autosomal recessive, mild)
  Uniprot ID: O75445
  ENST ID: ENST00000307340
  CDS Start-End: 388-15996
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatgataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggcattaaggccagctttcgaacaaaagtgcctgaaggtttgattgtctttgcagcatcacctggcaatcaggaagagtattttgcacttcagttgaagaagggacgtctttattttctttttgatcctcaggggtcaccagtggaagtaactacaactaatgatcatggcaaacaatatagtgatggaaaatggcatgaaataattgctattaggcatcaggcttttggccaaatcactctggatgggatatatacaggttcctctgccatcctgaatggtagtactgttattggagataacacaggagtctttctgggagggctcccgcgaagttataccatcctcaggaaggatcctgagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcagggttcctggaacttcatccatatatgtttcatggtggaatgaactttgagatttcctttaagttcagaactgaccaattaaatggattgcttcttttcgtttataacaaagatggacctgattttcttgctatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacagaatacctgtatcgagtgatagcctcgcatgaaggaggttcagtatatagtgattggagtcgaggacgtacaacaggagcagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggcatattgacaggcttgctacccttcaaaaactatgcagtaaccctaactgcttgcactttggctggctgtactgagagctcacatgcattgaacatctctactccacaagaagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagttattttccaatccttctgcatcgttaagctatgaagtgagtgatctccaaccgtacacagagtatatgtttcggttggttgcctccaatggatttggcagtgcacatagttcttggattccattcatgaccgcagaggacaaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgagatatgagcttctgagacgtaaaatccagcagccacttgcatcaaatcccccagaagatttaaatcggtggcacaatatttattcaggaactcagtggctttatgaagataagggtcttagcaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaactgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatggggagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttgaagtctgcacaatatatgcctgcgtgaaaagcaatggaacccaaattaccactgtggaagacactccaagtgatataccaacacccacaattcgtggcatcacttcaagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtctccagccatacaccaactacagcttcactcttacagcttgtacatctgctgggtgcacttcaagcgagccttttctaggtcagacactgcaggcagctcctgaaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtgctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaattgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaaccttctttttccaggtcatctgcacgactgacgaaggaagtgttaagacgccgttgatccaatatgatacctctactggacttggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactgtatgtggatgaagaggacctgatgaacgccatcaaggatttcagctcagtgactaaggaacgcaccacattcacagacacccacctgtaaaggatggaaacccagaagacgtaaccctggaatgcaaggtctgcacccatttcctcctgggttatcactcacacatcataaatgctgaaaagccattgtttattatcctataattctttaaagaaatgatgactgtttttgaaagtgttccttcctaatagaggtctaagaaatgatatttttctcatcttaaatgagagagaatattcatatgaaaatacttgatttgctcttattttgtagaagacaaagaagtatgtaattgtcacttggttctgtttggcagtgatgctcctggttaactgaataatcagtggcaatttcaagatggctcacagttgttagaagtagtaagttagttactggctcaaaaatgattctgttgaaaggatgtcactgctgttcatttctatctgccatttctgtcagggttgacacaatcctgcaagaatagttattctaatgatcacagctgctaaatgaatcccaaactttgcaccaggtcgacaaacttttctgaaggttctatttatttaccatacatagggttacttaccaaactttttgacaaggctgaaggttctatttatttacaatacatagggttactcaccaaactttttgacaaggcaacacataacttacacataaatgtctctgttcttgcatttatgaattttccaaaaatctaaggagtaaacagcttatttatacattttgaggagaaaacaaagtgtttcactaggaacacctctacttgaaccaatgtttttatttcatatattttatagttttgaaactagtttctcataaaattctgtcaattcactgaatatcagagaatactgacatcttcaacctagcacatttcaaatggaaactactgttctatttgcaatattaggctgcgtgaaattttaaaaggaaaaatgtatctgttccttctagcattaacatatatacatgtagagacaagactatacctatgtgtatatatatgtatatcatgtatatattactctgcactatatcccttctttttggagaactagccattattttagccacagaatcagtaagaacagatgatatgcaacagtaccaattacggttcaaaaatgtctgtcacctgctctagttggattacaaagtcattggtgaaagtcctatggcaagaaaaattttcttgcaaatcatccacataaaatcagatatttaaatttgttcttcatggaaaacagagtaagaaaacctcttgtcttccttcatccttaaaggtctttgtgaccccaggaaaatattgactctgtctaacacacaatagtcacaatactttttgtgaatctacaaccagagacaggcaaaaacttgtaaagtaagggatagtcttacttattctgcctgaaaacaatgtattaccccagggcccaacagtaaaagattgtggactttttgggtattgagatttcatctagctctgtgagagagcagctcctcagactgaccaactcctagacaaagtttgccaaccataagtgtcaaaagcacaggccagtattaagcagaagttctaccaccttattagaactgctataaacaaaagcatctgaaataattgtgcacatctggcagtgactgtagaaaatacgaaatatatatttctcgccaagtttttatactttctgaaatgaaaacataggattgactagtttactggtttttattcccatatgccgattctgggacaataaagttgtttaaagctggcacaaataagcattaaccaaggctgtgtccaccttctgtgagctacttaaggtatataggaaaggagtggtcacaaacttgcatcctaatccttggtggactcttctaagaatacagtttgctagtcacaaagaatagtctacaaatatgctttgctaggttcagaagattgagtttatcctgatttttgaaaaattaaccaggtatctttatcactgtgtatttttccaagcacagtataaaattttaacaacgcacaaaaaaatacagaactgcaggggattttatcttggatcattatccatttaatcatctaattagacatgaactcagttagctgaatcatttacattttgactccatagcttagggcagacagaagcctgtatggcttctgcccagaactctgtcccctgctacatgtctaagtttacttgtatttatttcagagaagaactctaagatgttgctttgctactttaagtggtattgcgtgccaagcctctattatacaaaccatgcagactcgcctctagagattctgattcggttgatctggggtgtgtggctgaggcatcagtactttttaaagcttccaggtgttctaatgttgagacccactgatgttccacaatctggaagaaatcatgtacaggaataatatgctatgcacagggactatgctccttggctcaccccttctcccttataaacaatgagcagttcttgatgaacctctttaaatttaaatctcctgactcacattttaccaattgtacatgccacattctcagcttacgaactaccatgttttgttattcttaatatcaactgtttggtaagagtacagttgtttttatacactctaagaaatgtgtttataatctactgtaatttccactaaatggaacccaaatattaatgttatggtaccatatactgatgtaaaaatcatgctggcatccatgaacacaccggtaaataaaacatagtccaagtggaagaattcattaataaggaacttttaattatgtcacaaatgaatagttggtttccaatgcacaaatatcatgtaaactaatctaaagatggtttgcttaataaatatttgaatgtgacc

SEQ ID NO: 198476 - DNA, 6320 bp, Homo sapiens
  Payload ID: 19169
  Gene Name: Usher syndrome 2A (autosomal recessive, mild)
  Uniprot ID: O75445
  ENST ID: ENST00000366942
  CDS Start-End: 388-5028
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatgataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttgacattgctttatttaggagacacgaagctccaaaatgttttctatattttcatatccctttacaatgaatttttattatacctacttagagaaatactaattcagccctttgatagcttttgcctgattgtttcagcatgtccatctttttagaattctggggaaaaaagtcaggtaagtgaaggaaaggaaaaataaaagatgaagatgaagaagcagccttattggatcaaagtatgtgctttgtatttgtctttttgtgaagtatgtgccaggacatgtttcttgaaatattattcactgtgttctctgagcaaatgagtttgcaaaatgccctcatgctattggagattctcagtatgcaccccgttactgaaactccaaaaagcattgtaagaaagctattcaactttgcttagctaatcatgcctaacagatatttgatgtaatgttttctttttctttctcttgctgtttccttcttctttttttcactgtgacaacttaatatctcatgttctatgaagaacattgtggggaaaactaatcccagggaaaagataacttctctaagccaggactatggtaaagcaagtgaggctcttgtttcggtcacaaaatttaaaggcactaaaaaactcagtgttaatgtaaattttaatgcaatatttttaaaaatgaaaatcaatgtgaaagcactataaaaatattatcaaaagcttaaataaagacagattgaactctgtaccagcacaatcctgcctcactggccttaccctcctcctggccttactagtaccgcaatattttggaagtcccatgacctctgtgacttacagcttctaatagcatgatttcaatatagctgtaaaaaaactctacttatggtacaccatttttccaatttttaaaaaaatttacaaagtataagatatatattattatgtaaactcataaagatgttcatttaatcatccatgagaaagtcattttggagcaaatagctagtctttaaaatattgcatatgtgaagacaatgaaatggaattcgagctataaaaatttgtattgttttatttttacttaaaatagtaaatagtttgcttttcattgagactggctgctgatgcaccttggtaatgaatcatgattatattctaactgagatatattgagattaatgcatgattaactactctctcagtacatcaaaatcattgcagagtattagaaattgaaccattgagctaaaaatgctcaacttctgctttatattcttaaaatggcaaaaaa

SEQ ID NO: 198477 - DNA, 4135 bp, Homo sapiens
  Payload ID: 19170
  Gene Name: USO1 vesicle transport factor
  Uniprot ID: O60763
  ENST ID: ENST00000264904
  CDS Start-End: 223-3144
agccgccacgtaatgccacgtccccgcgcatgcgcatcttggccgctgctggcggctgtttccgggcttagagggctggagtggccgccgagttggaggcggtggtggcagcagtaggagtgtgtagagtgcgggattggggcccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagatgatgttgaagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggtgataagatcgacagacggggaagcaaaatacaaacaagagttggattattaatgttgctttgtacctggctaagcaattgtcccattgcagtaacgcattttcttcacaattcagccaatgttccatttcttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaggatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtagtattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaa

SEQ ID NO: 198478 - DNA, 4034 bp, Homo sapiens
  Payload ID: 19170
  Gene Name: USO1 vesicle transport factor
  Uniprot ID: O60763
  ENST ID: ENST00000514213
  CDS Start-End: 228-3116
cttcgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattggggcccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccatttcttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaggatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtagtattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaa

SEQ ID NO: 198479 - DNA, 4512 bp, Homo sapiens
  Payload ID: 19171
  Gene Name: USP6 N-terminal like
  Uniprot ID: Q92738
  ENST ID: ENST00000277575
  CDS Start-End: 44-2581
actataaaataataatgaaatcttggaatagataagttactctatgaggactgaagctgttgttaattcccaaggccagactgattatctcacaaaggattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcctagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtagtaagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatctttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatatatatatatatgcaaaaaatatatatatacacacaagcactattttcttatgtcatttatgacattttttatctgtatacttttttgatgtgattgttttttaacatgctaaaagtaataagtata

SEQ ID NO: 198480 - DNA, 4546 bp, Homo sapiens
  Payload ID: 19171
  Gene Name: USP6 N-terminal like
  ENST ID: ENST00000379237
  CDS Start-End: 60-2615
gatgaaacctgttggatttctagaggaagcagctggagtctttggcttgttaactagcaatgattcaagtcttgcagattgtaaaggagctggtgacaccatcaaggcaaaaagcagccacagtgaaggaagattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcctagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtagtaagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatctttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatatatatatatatgcaaaaaatatatatatacacacaagcactattttcttatgtcatttatgacattttttatctgtatacttttttgatgtgattgttttttaacatgctaaaagtaataagtata

SEQ ID NO: 198481 - DNA, 11377 bp, Homo sapiens
  Payload ID: 19171
  Gene Name: USP6 N-terminal like
  Uniprot ID: Q92738
  ENST ID: ENST00000609104
  CDS Start-End: 396-2882
cggccgctgcggtgacggttggcggcggccggtgaggcgggcggggccggaggcgcggaggcggggtcccgggcgagccgccctgggaggcgggggccgtttccatagcggcggcaggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgaattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcctagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtagtaagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatctttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatatatatatatatgcaaaaaatatatatatacacacaagcactattttcttatgtcatttatgacattttttatctgtatacttttttgatgtgattgttttttaacatgctaaaagtaataagtatattttgtgtcttttatgtgcatttttttcatacggcaaaaatggtgcaccccctgatgctttgaaggctaattctcttctaatggagtagctgttgcctagtattcacctgtgttactttgtatatgtcacagttctatgtttaatgctttactaatttccagtaagactatatttaaaactacatagtctttccttattttatttagtatgacattgtcaatagtaataaggtagcatttctagtcttcctcattacaaaatgtagctgttttctaagtaggaaaatgtaatttgaaattatcttgccaccatacagttttactttttcaaatttattttttaataagagataatgaaataatgatataaaaagattggtaaagtatatttatgaaaaacccatttagtacagattttcatagtgtagagactgattttgccctgtaactgcatgtacatggtgtattttgccattaagtcttttatttgtggcaattttgccttagtaggcgcttggcgtagtttctattttatagaatatttagtctgagaagttaaagaaactagacctaggatctcaaaagttttaaaactttgacgttttcatatgtttgtttattaataggattttaaaaaaaatgaacatctttttaaagctgggaaatgtatataaattcaggtatcagtatcaataatagactgtttcattgaaagaatgaaaagaggccaggtgaagtagtaatttataaatttagtatttgcagtggttcacgcctgtaatcccaccactttgggaggccgaggtgggcggatcacgaggtcaggaaatcgagaccatcctggccaacatggtgaaaccccatctctactaaaaatacaaaaattagctaggcgtagtggcatgtgcctgtaatcccagctactcgggaggctgaggcaggagaatcgcttgaaccagggagtcagaggttgcggtgagccgacatcacgccactgcactccagcctggcaacagagcaagactccgtctcaaaaaagtgaaaagagattcaaccaagaggacagctctggagcagaaaaatacatgtttataggatgcgattgtttcaactttctttttccattttaagaagattccatttcggaagaagatgccgaaatttacaaatttcgccatactcagtgggactctcaagtagactttcatagttgcagtcacttcaggtctctccctcgggttcccttaggatgcaagcacaagaacagacacctggtcagcatggtgctgaaacccctttctcttcactgtcatggtgcgagaaaagcatgccatgtctacgagtaggatctcttcacggaggacctgcagcttcatcttctggattggagattattcttggttatgttttggaatcagtcctttatcttagtgtgcacttgattgtgagttttaagattatggttttaggatttcttttattttttgtcttttaaattgttctttaatggattttaaatgtctgtatctaatgtgggtattaatgctttttggccaagtggattttaagaagtgaaactttttttttttttttttttttttgagatggggtttcactctctcacccagactggagtacagtggggagatctcagctcactgcagcctctgcctcccaagttcaagcgattctcctgtctcagcctcccaggtagctgggattaaaggtgcccaccaccacacctggctttttttttttttttttttttttttgtatttttagtagagacagggtttcaccatgttggccaggctggtctcaaactcctgacctcaagtgatccacctgcctcggcctcccaaagtgctgggattacaggtgtgagccactgtgcccagcccaaacttttaagatgacccaaagtcgtgagaataggaaaaaggaatctgattaacatttatgcattttattttcagaaggactttcagttatccataaatctaagcataactgctaccatttatacatgagaaaatgacagaggaactaatataagagcagatcttgacccttgctgggtcactataattctttagaattactgagtgaactttaaaaaaattttctgcataggttatatcccagaccacttaaatcagaatatcttggatggaacccagacatcagattattgtattttcccccataatttaaagttcagtcattaagctgttacatccctctgaagttgattgtcttatattcccgctatgagatatctcaaagattcttaatcaagagtttcagagtttagaaactcggatgttgggcaagttaggaaatattccaccagcaaaattaacattaccagccatctctgcaaatgctcctgaactgctgacagttacggcatcaaacggaagacggcaggccctgtccttccactcaggtgctgcttgcagtgctcctcaacagagggagagtctccctaagatttccatgttcctagacaaagtcctaagctgtttggaagtctgtgagcattttcagtatatgaggagctgagaaagcgctgcctgtctggtccttcatttggccagctaacattctgtcgagcacctgcattgtgctggattcatgcttccagatgtgagatgtgtgttctaatctgacagtgtgttttgtaatctgtcaatcagtgttggagatatgcccaggctattacaggcatattatggacaaatataaaggccaactagtgatcccagcccaagaggttcagggaagtcttatgaaggatttgtctcagctgagcctgacaggacaagcatatagaaagacaagagggggagagagcagggcattctgcagaggggaccgatggcaagagcagctgcatgggatgtgtgaggaaatttgccactgtgatgtgtatgtggggtaggcatgggggtggacaggggtgacgggctccacagagacaggatggtggagggagttgtgtgcagttgaacttgatcctgtagttggttttgacctggtgtggtccctccatgctgtggaagtgaaatgtgagggaacaggcctgggggcagtgagggagacaggacaagcctttcatctaaaaggtggcacagagcttaaggccagggaagaaggtatgaagaaaaggtgattgagaactaattaccaagggaaactggcaagacaactggatgcgtgtaatccgaatggtcataatgagacaacagctaacactgaatgcttgctgtgtgtttggcactctgctagacgttttactggtattaaccgatttaatcctcacaataacgaagtatgtactactataattgccagtttacagacgagaaaactaaggcacaaagtttaacttgccccaagcgacagagtggataagtaaaagggcgaggactgggaccctggtactctgaatgaagagcctgtgcctccctctctcccctaacagttttaaggagatacaatttacctgccacaaaatttacccattttaggtttatacttagatggttgttcagtaagtttatagagttgtgcaactatcacaaccaatgttagaacaactcaaaaaaaaaaaaaatcttattccagtttgcaattaagccccatttccatttccacacagcaactgatcggctttctgtccttcaggtttgccatttctgaacatttcctataaatggaatcagacatggtcttttgtgtctggcttctttcactcagtaatgtttctgaagttcctccctgtagtggcatctatcagtaattgctttcctttttattgctgggctgaatgctgttccattgtatggctgtgtcagattttgtttgttcattcaccagttgatagacatgtagattgttttcatgctgctgtgaccatttgtgtacaagtgtttgtgcagacatatgtttaactttttaggaaattgccagactgttttccaaagaagctgcaccattttacatttgcaccagcaatgtaggagggttctgatatctccacgtcctcaccaacacttgtgattatgtgtcttttaaaattatagccatccttgtggatgtgaagtggtaactcattgtggctttgatttacatttccttgatagctaatgatgagcatttttcatgtgcttatgggccgtttatatacctttggtgaaatgtctatttaaatcttttgctcacttttcagttgggttttttttcttattaaatagtaagagttcttaatatattctggatacaagtccttttaagacatgatttgcaaatattttctcccagtctgtggcttatcttttcctaatggtgtcttttgaaatgcacttgtttttaattttaatgaagcctaatgtattagtttccttatacgagttatgcttttagtactgtatctctctctgcttaactaaaggtcacaaagattttctcctatgttttgttctggaagttttatagttttagctcttaaatttgggcctgtgagctgttttaaattaatttttatatatggtatgaggtaaagatctaaattcctatggatattcagtggtcttagcaccatgtgttaaaaggactgcttttccccactgtgtccctgtcaaaaatcaactgaacatatatgtaagagttatttaaattttgaaattgggacgtatacattctccattctttttgacattattttggctaatctgggtcctctgcatttctgtataacttacaaggtctggttgtcagtttttgcaaaaaggcctgctggggtttccatagggaatgttttgaatctatagatgagtcaaggaagaactgccatcttaacagtattgggtcttccgatttataaacatggaatgcctctccatttattttgatctttaatttctctcagcaatgttgtataatatcagaatatgtcttgtacttctatggttaaaattagtactgctttctctcgtgaatggagctgttttcttcagagcctttgctctgaaacatcacgctcccctgtatggggagaagaagggtcaagatggatttctgcagttcctgcgttgggcagtagggtgaagagtggggccatcatctcataaaaggaattcagaaggtgctggtttaggtttagtgggaaaacgacttctgttttgacatgtagagtttgaagattaggagattgacagatgatgttgtctgacaggtggttggctgtcccagagagagatagagactccccagcatgtagggggcagagtcacaagagtgctggcctgggagatatgccagccaaggtggggcacctgggacaacagcacagctgagccgcagacacgaagacatttgttaagttatcagccacgtctgcatcacagactacaggtactaccatttagcggagttatctttgaaaagacatcaacatccctgtgcatttgtcagtctggtagagtggactggaggttgtcaagtctgcattgtagtctgagtgtgccacatgttagcaatgtgaccttgggccacacacctcttctgggccttactttgctctgctgtaaggtgtgggcatttaagaggtaccagagggaaaggagcctccgaaggactcgcaggggcagtcgcagctgatgtttgagtgccctgggatgggagtcagactggctgaggtttcaattttgcattcatggccagccaccgttccaggtcctgttgagatcatcatgtaacaggacaacaaagtccctgtcctcatggggcttatattctgatccatttcctcatctatgaaatgaagattgtagtttttatttcatagagtcatgaagattgagttaatctctgaaatatccacacagtgttgtcactcaggaatgatttggaatgttagggatagtcacccaccaccacagtgctaggtttcagtgaccaggagcgatgtggagctgagtctagtgggagtccagaggtaaagacacagtaaggtcacatgtgacccaggagggaggaggcacaggcagggcaatctgaggagactgtgccatggctggaggagcaggggctccaggaaggaggcagcatctgcactggaaatgcagcaggagggcccagtgagggaggcctggaaagtccacttggacttgacaatgaggagctctctgctgtcacctgctgtgattcctagagtcagaatcagactgcagtggccacaggcacaagtgggaagtgatgcagctcaaaggtttggatgagatgggatgtgcagcgattgagtcgtagctggagcgaaggatgtgctaagttagggattggaggggcgtgcatttacatgggaaagtaatgctaattagaaatcagttggacttcaacattctcaagtacttccacaaagcatcccttggttttattccagtttgttgctttacgtatttgtaagtattaaacaccaattactaaattatctgtaattcagatttgtcatttggaggaaaatcaacataatctgaatataaagcaggcagcattgagaaa

SEQ ID NO: 198482 - DNA, 1748 bp, Homo sapiens
  Payload ID: 19171
  Gene Name: USP6 N-terminal like
  ENST ID: ENST00000609853
  CDS Start-End: 164-310
aactgcttcagagccttcatggatagctaggcaaagcattcatttctctgaagttgaactgtgttcgtgcttgagctttctgaaagcagaaatgagcttctggtgatgaaacctgttggatttctagaggaagcagctggagtctttggcttgttaactagcaatgattcaagtcttgcagattgtaaaggagctggtgacaccatcaaggcaaaaagcagccacagtgaaggaagacggagtcttgccctgtcacccaggctggagtgcagtggcgcaatctcggctcactgcaagctccgcctcctaggttgacaccattctcctgcctcagcctcccaagtagctgggactacaggaacccgccaccacgcccagctaatctttttgtatttttagtagagacatggtttcaccatgttagccaggatggtctcgatctcctgacctcgtgatccacccgcctcggcctcccaaagtgctgggattataggtgtgagccactacgcccggcctggatgctacattcttaaaggatgctgattttatcttggtttcttgcttttttaagttatctctcatgttctttgatttgctctatgttgcttctttctgtggtcttcttgggtatactcaagtgtgtatcgcatatgtttaacaaaggaaaaatagtgttaaaagaaaaagtatcacttaatataagaagcaaaacttagtttttgtttctatgatagtgacatccaggtatgatttaggttatttttcactttaaacgggctattaacttcacgtgagaaaaaaactgtagaaacgttaactcctgtagaatgatgactatctgtggtgtagtaagatcatacaacttctctacttgttactgtgagttgcttaataaatggcagtacaagtgtcaaatccataattagtcaatatcaagagctgcattttggattgcatgtactgtcccaaatatatgttgtgcaagttactttgtatcatgttaatggagaaaagagtggatattatgaaatcagcaatataaatcaaatgtatatgtggtcctgcaatgtaattgaaggtactcagtgttctcagacactcatgcaatatcttgtgttgctttctcagattttttaggtgtatcataggggatagctgggaactggtagagcagaggtactaagttccacctggaaatgctttagagtagctctttgaatatgtctttacttattatcttacagcgtatgtgtatatgattattttctagagggtcgtaccctttattaagctgtgagcttcttgagggcaaggactgcaattcattaatcattttggagaaaagtgaataattctgaagaattcggtggttcatgagcttgcctggtatttgtttctctatggcttatcatctaagtgagataacagatagtagataattgataaatttaatctgttacctaattactgagaggattcgattcttgctttatgttattactgaaacagactgcccagtaatcttctctagagagcaattaggtttgcaatgagttattttattgagaatgctacttgaaattaaatgtttatagcactatcttgatataatttaaatataatttaaatgtgctgaagtatcttcattcagataacttgttaccccttaacaaaaggctgcttgagtattgtttctctcccatttggcaaacaccagatgcagtgattaataaaggtcattatgctac

SEQ ID NO: 198483 - DNA, 2019 bp, Homo sapiens
  Payload ID: 19172
  Gene Name: UTP11-like, U3 small nucleolar ribonucleoprotein (yeast)
  Uniprot ID: Q9Y3A2
  ENST ID: ENST00000373014
  CDS Start-End: 62-823
tggcggcagaggcagtgcggatccggcgttctccactgatcttttccaaggctgtacagacatggcggcggcttttcggaaggcggctaagtcccggcagcgggaacacagagagcgaagccagcctggctttcgaaaacatctgggcctgctggagaaaaagaaagattacaaacttcgtgcagatgactaccgtaaaaaacaagaatacctcaaagctcttcggaagaaggctcttgaaaaaaatccagatgaattctactacaaaatgactcgggttaaactccaggatggagtacatattattaaggagactaaggaagaagtaaccccagaacaactaaagctgatgagaactcaggacgtcaaatatatagaaatgaagagggttgcagaagctaagaaaatcgaaagactaaaatcagagctccatctgctggatttccaggggaagcaacagaacaagcatgtgttcttttttgacaccaaaaaggaagttgaacagtttgatgtcgcaactcacctgcaaacagccccggagctagtcgacagagtctttaataggcccaggatagagaccttgcagaaagaaaaagtgaaaggagttaccaatcagactggacttaagcgaatagctaaagaaaggcaaaagcagtataactgcctgacacagcggattgaacgagagaagaaattgttcgttattgctcagaaaattcaaacacgcaaagatcttatggataaaactcagaaagtgaaggtgaagaaagaaacggtgaactccccagctatttataaatttcagagtcgtcgaaaacgttgacgtgttatagataagccttgtcattctgtatcaaaaatctgttgtcgttttctagtaacttcaaattccattactccaaatggcatggttttccggtttgtaaccataactaaattgtcagtctgacatttaatgtctttctatggacaacattaaatctccctcccttctgtaattgtttttggattgtgaaattagtcttatttttatatacttaattttttttttctttgagatagggtctttgttgccaggctggaagtgcagtgtgtgattatggctcactgcaactttgaactcctgggctcaagtgatcttcctgcatcagcctcttgagtagctgggaccacagacatgtgccaccatgtctgagtaatgtttaaattttctgtagagaccaggttttgccatgttggccaggctggttttgaactcgtggcctcaagcgatcctcccaccttggcctcccaaagggctgggattacagggatgagccactatgcccagcccataattttttttgttatgaaacataggatctcattacagcagatttggaaagtagattaattcattcctaatcccagtgcttattcaataataacaaatatttattgcatgcttaactgtgctaggagctagagctgtggaggtggacaattactgtgagtagtctagttgatttcctccattttgtaaaacgaggcatcactttttgtccatgtttttgtgttttatagttacagtaaacaatttgatgtcctactttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcctggctaatttttttttgtatttttttagtagagacggggtttcaccttgttagccaggatggtctcgatctcctgacctcatgatccacccgcctcggcctcccaaagtgctgggattacaggcgtgagccaccgcgcccggccgatgtcctactttttaattaaatcattagctctttcccagtttgttacatcacaaaagttttttacagtaatatatgctagagtaaacgttaaaataaatattatttttaatgattgc

SEQ ID NO: 198484 - DNA, 5529 bp, Homo sapiens
  Payload ID: 19173
  Gene Name: UTP14, U3 small nucleolar ribonucleoprotein, homolog C (yeast)
  Uniprot ID: Q5TAP6
  ENST ID: ENST00000521776
  CDS Start-End: 734-3034
gcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgcccctaaggagaagaaagagaaggagcaactgatcaacctacagaacttcctgaccacacagtctccttccgtgaggtctttggcagttcccacaataatagaggagctggaagatgaagaggagagagaccaaaggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccagtttctcattaaagcccctgagggtcctccaagaaaagataagaatttgccaaatgtgattatcagtgagaagcgcaacatccacgcagcagctcatcaggtacaagtgcttccatatccatttacccaccatcggcaatttgaaaggaccatccagacccctataggatccacatggaacacccagagggctttccaaaagctgactactcccaaggtcgtcaccaagccaggccatatcattaagcccataaaagcagaggatgtgggctaccagtcttcctcaaggtcagacctgcctgtcatacagaggaatccaaaacgaatcaccacacgtcacaataaagaagaaaaactgtaggttgtgtagctggagaagtgacagtcaggggccctgattccacttcctttggtccagttttactctgctacagggtggattccaaaactggctcagcacattgcatgtagttgagccacattttttaaaaaaagaaaatggatgaccattaattgactagcattttagaattgatcagacattagaacacagaaaaattctagtacatttaaattctaaacaatacagtggatgacccttttgaatatacctaatgatttccttaaaaaagaaattttaaacagacttgtttaatcgtgttctcaaagcatacagtcaagaggtgggactgactgatgctttataggtgtgtgtagggtggtagaggccaaggtgctgccagcaatcctttccatactaggtactggtgaaaattgtttttgtttatgctgtcagcacatttgtgtgggtctctcattgtcccttaacagtgccgcatctcagcctggaagtcagctttaagtcattcaagagaacctcaggctgtttttctgacagtgatgatatgatatacagatacatccacagggtatctattaccagcataatgcattgtaagatggcaaggtggcattttgaaagagcgctgggcaagcagttagcacatctgggcctaccttcagcttcttcatttacaaacttctgaccttttgacactaaagctgctcctttatctttctgagtctcagattcttcatctgtaatctggagttgttaattccagtccttactaccttttagagttggaatgagatggaaagtagatgaaactactttgaaaattacgacagttaagggctgggtgcggtgtctcacacctgtaatcccagcactttgggaggccgagatgggtggatcatgaggtcagcagttgagaccagcctgaacaacatggtgaaaccctgtctgtactaaaaatacaaaaaaattagctgggcctggtggcaggcacctgtaatcccagctacttgggagactgaggcaggagaattgcttgaaactggaaggcagaggttgcagtgagccaagattgtgccactgcactctagcctgggcaataagcaaaactccatctcaaaaaagaaaaaaaggaaaaagaaaattatgagagttacttaaaggtaacatcacatactaaatgtcttctataatcctatatttattaatgcattacaactctgtagattgttagttactaggccagtagctaggaattggtataaatttaatgcaccttctatcctgaataactagcatggaaaagtgaatatatgtgtgagcagatatggctataaagacctatagcttttgcactttatgcatatataatcaatcctttctagttcagtgaattgaccccatccacaggctgattcatctttgtgttaaggggcaaatgaaacggtatattatttctttgcagtctcctctcagtcattcatcaatgtggccagcttatctactcccaattatgttgttgatacatctccaagccatctgtcatcagatcaaaaagcagcaaacagagggtcagtcacaggatgttctgacacaccattgtaactttttgttagagatgatcccatttagaaaaagactggtagaaattggagtgaaaggaaccctacagattagcccagttctctcttattttcagctttacagacaagaacaatttaaatctaaagaatttagtagattccttcagtgtcacaaagctgtttcatgaaagaatcaagattataacctggatattctgactcctggcccagtgctttttcttactttgtagctacactttgaagtaagattcaaactgttatccactcaattgccttattcctgaggatgtagtgaaggaagaaaaagttttctggaattccgtaaattatattttaagcttatttcttcaaaattattttcatatatcacagatatatcattggaagatataatttgcatatatgttcattatcagtgttcctaatttggtattacatgtattctatttttttctgaatgatagcatgaaaagtgtcaaagtggtttgtccgctagcgtctgtctgcagaactttcaggatgactattaattcctctcagatgtcatttttgagtggtccaagcctgctgttttgaacccacagcagtggagatttgtattcttatttacagttgtgtactataaagtgtgtgttacataggttttgtgtaataattatttgtaaatattatttagatttgtatttagacatgatttatatctaatatagatacaaagtctgtgtctaaatattatttaaagaagtgatttttcattctcttggattctttccagtgtggtgccttttatatgcctcacatagtctccttgttctcctactaatattcccaagctccatatgccaattaaagaagaaacaaaaataaaagtttgtcttgcttgtgaaacattaa

SEQ ID NO: 198485 - DNA, 2488 bp, Homo sapiens
  Payload ID: 19174
  Gene Name: UTP14A small subunit (SSU) processome component
  Uniprot ID: Q9BVJ6
  ENST ID: ENST00000394422
  CDS Start-End: 29-2344
gtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggcggaaattggctgagaggtctgaggctagtctgaaggtgtcagagttcaatgtcagttctgaaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacggatccacagagaagtagcattcaataaaaccgcacaagtcctctccaaatgggaccctgtcgtcctgaagaaccggcaggcagagcagctggtttttcccctggagaaagaggagccagccattgctcccattgaacatgtgctcagtggctggaaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccggtttctcattaaagcccctgagggtcctccaagaaaagataagaatttgccaaatgtgattatcaatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtagttaagccacattttaaaaataaaggcattttttaatcta

SEQ ID NO: 198486 - DNA, 2403 bp, Homo sapiens
  Payload ID: 19174
  Gene Name: UTP14A small subunit (SSU) processome component
  Uniprot ID: Q9BVJ6
  ENST ID: ENST00000425117
  CDS Start-End: 91-2250
acggaaacagaaattgctttgcggcccgcacggaaattgctttccttcggcttccgttcttggtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggcggaaattggctgagaggtctgaggctagtctgaaggtgtcagagttcaatgtcagttctgaaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacgggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccggtttctcattaaagcccctgagggtcctccaagaaaagataagaatttgccaaatgtgattatcaatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtagttaagccacattttaaaaataaaggcattttttaatctatttacctgg

SEQ ID NO: 198487 - DNA, 979 bp, Homo sapiens
  Payload ID: 19174
  Gene Name: UTP14A small subunit (SSU) processome component
  ENST ID: ENST00000427972
  CDS Start-End: 20-979
tttaaagtgtggctgcaggatgaagggagactttagaaaaaaaaaatcagaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccag

SEQ ID NO: 198488 - DNA, 3687 bp, Homo sapiens
  Payload ID: 19175
  Gene Name: UTP15, U3 small nucleolar ribonucleoprotein, homolog (S. cerevisiae)
  Uniprot ID: Q8TED0
  ENST ID: ENST00000296792
  CDS Start-End: 256-1812
gtacgtcatcttcgcgcgacgttcggttcgctgtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggagaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataagacccctgttcagattaaggaatttggtgcagtttcaaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcagaagcagttctgtggaagagactggaataattatggccggaaaacaagtacccgttttaagtaagacatggttttccatgtaatattttgaattatagcatcttcacctagaagatctcaattgtcttagtcacagagtaggtttatctgggatggatattaattttaatacaggagtgttctgtatcaacatttgggttggtattcagatgggaattcaaatatgaatcctctctggagagggtccaactgggaatcctgctaaaggagcaaagccttgtattacctctggaagacaacaaaaacaattggcaacaacaaaaagcctctttcttgactttaatcagtgcctttgggatttctaggcccttgcttagcttgcttcctgtctccttgatatctacacttgtcttagatcacatgccctgcttcagctggtaatgggactgcatcggttccaagtgtggcaagtaagttttcggctctgaagaactgacactagctagatttgtattcagagtgtgagagcaagctctacagatagaccttattggactacttttttttttttcttcatgcagcctttctaccaagttttcaccttgtttcaggtcagaggaatgatagaatttgtcatttttcttacaacagcctttcagactattcttcatatgtttcaagctaatcttgtagctaagctacctaatcctctgaaaactgttttctctgatttgtatttagattcctccccccattattcacaatcatattgtatttcggaaccccaatgcagagcagtttgctttgaaaaatagttgtttttaaaagtttaatgtaaataattattttttagaagttttttttttttttttaaagacagggtctcgctttatcgcccaggctggagtacagtgatgcaatctcagtccactgcaacctctgccctcccgggtttaagcagttctcctgcctcagcctcctgagtagctgggattacaggtgtgccccaccacgcctggctaatttttgtagttttagtagagacggggtttcaccttaccgggctggtctaaaactcctgacctcaagtgatctacctgcctctgcctcccgaagtgcttggattacaggtgtgagccactgtgtccagcctgtaactattatttttttataaagagagattcttattttcttggctttttgatgtatctgttcctgatagataatcattggctagtaactcctagtacactggtttcacagttgctacctctcctgcttttctctaattattacgccaactcaagtagttaaaaatcagtaagaaaaatgtcttgagctagaagaacccatagaggaagattttgtaatgcgaatctcctctcataattttagttctgtaaattcagggtttttttttgtttttttgttttttttaagccgaaaaaatgcttaatatgttccagtaagggtattaagtaaaaattaaataaacgtattaagtttaacatattaaattaatttaacatttagactaacattaacatttaaattaatatgttaagtgaatatacttaatatattctagtacaggtatgcttggaaatagggcgtttccttttcatgaattgatttcgtacagcacagtggcttataaggaaccagcagtgtttttccctgagtaattatgaacttagtcaagatcagaagctgggttttggggttgagaagagttcatttatttaaataaagtttctatttaaaaaccttt

SEQ ID NO: 198489 - DNA, 2057 bp, Homo sapiens
  Payload ID: 19175
  Gene Name: UTP15, U3 small nucleolar ribonucleoprotein, homolog (S. cerevisiae)
  ENST ID: ENST00000509005
  CDS Start-End: 1-1637
acgtcatcttcgcgcgacgttcggttcgctgtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggagacccctgttcagattaaggaatttggtgcagtttcaaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcagaagcagttctgtggaagagactggaataattatggccggaaaacaagtacccgttttaagtaagacatggttttccatgtaatattttgaattatagcatcttcacctagaagatctcaattgtcttagtcacagagtaggtttatctgggatggatattaattttaatacaggagtgttctgtatcaacatttgggttggtattcagatgggaattcaaatatgaatcctctctggagagggtccaactgggaatcctgctaaaggagcaaagccttgtattacctctggaagacaacaaaaacaattggcaac

SEQ ID NO: 198490 - DNA, 538 bp, Homo sapiens
  Payload ID: 19175
  Gene Name: UTP15, U3 small nucleolar ribonucleoprotein, homolog (S. cerevisiae)
  ENST ID: ENST00000508686
  CDS Start-End: 517-538
gcgcgacgttcggttcgctgtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggaggtaggtgaaggcggctcccattgagggaagcccacactcacacccggccttcctgtgttaatctggcatgctcttctggggcttcccaggctatataggagagtggccaaattctttaaccggctcaagttcccctcaattaagcttcgacctaggttcttctctgcgattacaccctttcctgtccaccgttgttagttcccggagtaatcagcaactctccaaggcaatggacacatttccatctttgcctttgcttacgaggctccctcagaattaaggcagagtcactgtaattatttctaataccaattccaaaatagtgactcttggacaatagtgcaattatatggaattatggctggttataagcctgtag

SEQ ID NO: 198491 - DNA, 1828 bp, Homo sapiens
  Payload ID: 19175
  Gene Name: UTP15, U3 small nucleolar ribonucleoprotein, homolog (S. cerevisiae)
  Uniprot ID: Q8TED0
  ENST ID: ENST00000508491
  CDS Start-End: 224-1723
gtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggagaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcag

SEQ ID NO: 198492 - DNA, 577 bp, Homo sapiens
  Payload ID: 19175
  Gene Name: UTP15, U3 small nucleolar ribonucleoprotein, homolog (S. cerevisiae)
  ENST ID: ENST00000513824
  CDS Start-End: 382-577
ttctttcgccttctggctaaaaaacgttccgcagcaatgcagctgaaactttcgggttttcttttttttgtccctctctccttttttttaatatttttgtttttgccgcctttacgctccgaggcccatcctgccggagtactacacagacagggtcatttcagttgacggttctgggtcaccagagcagaggaagccccaatttcgccctccggtcacacctcctactccagatcgccccgcccacctgacccgcctctgcgccgccgggctgcgtgagtctcatgagcgtgctctgaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataagacccctgttcagattaaggaatttggtgcagtttcaaaagtagacttttctcctcagcctccatataattatgctgtcacagcttcctcaagaattcacatttatg

SEQ ID NO: 198493 - DNA, 4922 bp, Homo sapiens
  Payload ID: 19175
  Gene Name: UTP15, U3 small nucleolar ribonucleoprotein, homolog (S. cerevisiae)
  Uniprot ID: Q8TED0
  ENST ID: ENST00000543251
  CDS Start-End: 653-1639
gtacgtcatcttcgcgcgacgttcggttcgctgtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggagacccctgttcagattaaggaatttggtgcagtttcaaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcagaagcagttctgtggaagagactggaataattatggccggaaaacaagtacccgttttaagtaagacatggttttccatgtaatattttgaattatagcatcttcacctagaagatctcaattgtcttagtcacagagtaggtttatctgggatggatattaattttaatacaggagtgttctgtatcaacatttgggttggtattcagatgggaattcaaatatgaatcctctctggagagggtccaactgggaatcctgctaaaggagcaaagccttgtattacctctggaagacaacaaaaacaattggcaacaacaaaaagcctctttcttgactttaatcagtgcctttgggatttctaggcccttgcttagcttgcttcctgtctccttgatatctacacttgtcttagatcacatgccctgcttcagctggtaatgggactgcatcggttccaagtgtggcaagtaagttttcggctctgaagaactgacactagctagatttgtattcagagtgtgagagcaagctctacagatagaccttattggactacttttttttttttcttcatgcagcctttctaccaagttttcaccttgtttcaggtcagaggaatgatagaatttgtcatttttcttacaacagcctttcagactattcttcatatgtttcaagctaatcttgtagctaagctacctaatcctctgaaaactgttttctctgatttgtatttagattcctccccccattattcacaatcatattgtatttcggaaccccaatgcagagcagtttgctttgaaaaatagttgtttttaaaagtttaatgtaaataattattttttagaagttttttttttttttttaaagacagggtctcgctttatcgcccaggctggagtacagtgatgcaatctcagtccactgcaacctctgccctcccgggtttaagcagttctcctgcctcagcctcctgagtagctgggattacaggtgtgccccaccacgcctggctaatttttgtagttttagtagagacggggtttcaccttaccgggctggtctaaaactcctgacctcaagtgatctacctgcctctgcctcccgaagtgcttggattacaggtgtgagccactgtgtccagcctgtaactattatttttttataaagagagattcttattttcttggctttttgatgtatctgttcctgatagataatcattggctagtaactcctagtacactggtttcacagttgctacctctcctgcttttctctaattattacgccaactcaagtagttaaaaatcagtaagaaaaatgtcttgagctagaagaacccatagaggaagattttgtaatgcgaatctcctctcataattttagttctgtaaattcagggtttttttttgtttttttgttttttttaagccgaaaaaatgcttaatatgttccagtaagggtattaagtaaaaattaaataaacgtattaagtttaacatattaaattaatttaacatttagactaacattaacatttaaattaatatgttaagtgaatatacttaatatattctagtacaggtatgcttggaaatagggcgtttccttttcatgaattgatttcgtacagcacagtggcttataaggaaccagcagtgtttttccctgagtaattatgaacttagtcaagatcagaagctgggttttggggttgagaagagttcatttatttaaataaagtttctatttaaaaacctttttaaaaagttaacatcataaatattctgataatttgcatagtagtaaaaattagaagttgaaattctacctaaagctgtagttgccgtcaattgtgtaacatgtgacaaaggttttcccatatgtcatttcatttgattctcaccacaaccatccaaggttgatgttattctcatttaacattgagttaacgaaagtagttgattcactctcgaagtccctgagtgtgagctcttcatcctagcactgtgaagtggtttgcctgctggggcctaaactcctcattccctttaacaaagcttcactgagtgctgcagttctcaaaatatgtaacagttaacacatttttcaaacaggttaggaagcaattcccatagccatcaatacttaaattcaggagtacttttttgtttgtttgttttgttttgtttttagagacaaggtctctttctgttgtccaggctggagtgtagtggtgtgatcatagctcactgcagcttctgtctcctaggctgaagctatcctcccacctcagcctcctgagaagctggggctacagggatgagccaccatgcccagctaattttttattttgattttttgagataagaggtctcaccatgttgcccaggcctgaggcaatctcctggtttcaagcaatcttcccacctcagcctccttaatgactgggattaaaggcatgagccactgcgcccagcaggaatggttattatattcattgagataaactgtagtatttgctgtttgaagtatttaaacataattggcatattacaatatgtgacactggccttaagattctaatttaaaatgcttaacagacttttagacttatgagtttcagttgaaaggtattttaaaatgttactaagtctgcaaaagtactgaaatgtttcagagaacttggaaagtcaccgtatgtttaatttattatgtttatgagatttaagcacttgggaaggtttatgctaatggggtcaagcatttgcaatgctgcttaaaagaatcatttttttaaatgtataaatgctattaagttgtttaaaggaatttgaattgtaaatgggattgttaaaacaaatttagtctgttcaactcaatgagggcatttcattttctaggaacaaaataccctcttagacattaaaaagccgcatgcctgttccctcagctatagttaactggaccatggtggtacaactgactcaacccttctctaagcagggatttgtaattgggatttataatgaaattcctgatctgggaaaatgggaggctgggaatgctatgtctaggtcatcagcggagaaagttggtttgtagagaatgaacaagaatgaaacctaagtgcaaagaaaataaagattatcctgctttaatagttcaga

SEQ ID NO: 198494 - DNA, 1894 bp, Homo sapiens
  Payload ID: 19176
  Gene Name: UTP18 small subunit (SSU) processome component
  Uniprot ID: Q9Y5J1
  ENST ID: ENST00000225298
  CDS Start-End: 58-1728
gggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 198495 - DNA, 592 bp, Homo sapiens
  Payload ID: 19176
  Gene Name: UTP18 small subunit (SSU) processome component
  ENST ID: ENST00000508506
  CDS Start-End: 1-130
gaagaactgccagcatgcgaatgctgaacgtcctactgttgctcggatctcatctgtgcagttccatcccggtgcacagattgtgatggttgctggattagataatgctgtatcactatttcaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaa

SEQ ID NO: 198496 - DNA, 577 bp, Homo sapiens
  Payload ID: 19176
  Gene Name: UTP18 small subunit (SSU) processome component
  ENST ID: ENST00000583725
  CDS Start-End: 1-534
atctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtgggttaaaactggggaaactgcttgtatatatatccctaccaccgtttgcaaattggagtttgggaggaaagttctaattgtggagtggtaaatatatacaatcaagattcttgtctccaa

SEQ ID NO: 198497 - DNA, 464 bp, Homo sapiens
  Payload ID: 19176
  Gene Name: UTP18 small subunit (SSU) processome component
  ENST ID: ENST00000582832
  CDS Start-End: 1-348
gatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttga

SEQ ID NO: 198498 - DNA, 664 bp, Homo sapiens
  Payload ID: 19176
  Gene Name: UTP18 small subunit (SSU) processome component
  ENST ID: ENST00000583205
  CDS Start-End: 1-432
aagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtgggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagc

SEQ ID NO: 198499 - DNA, 567 bp, Homo sapiens
  Payload ID: 19176
  Gene Name: UTP18 small subunit (SSU) processome component
  ENST ID: ENST00000579261
  CDS Start-End: 1-371
cagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggcctgttgtcttaacagaacggaggcaattctcgggttttgaaagttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaataa

SEQ ID NO: 198500 - DNA, 9025 bp, Homo sapiens
  Payload ID: 19177
  Gene Name: UTP20 small subunit (SSU) processome component
  Uniprot ID: O75691
  ENST ID: ENST00000261637
  CDS Start-End: 175-8532
aggctcctccttgtctccaacatggcggcgcccaggggctcaagccgcacgtgagaaagtctgggcatctgggaatcggagagtatagcctgtgagccgctttcccctccttactgtcggttgcatcccttcgacactcccgaggccgtcgcgggccactggccctctgcagccatgaagacaaagcccgtttcccacaagaccgagaacacctaccggtttcttacatttgctgaacgactggggaatgttaatattgatattattcaccggattgatagaactgcaagctatgaggaggaggttgaaacctacttttttgagggtctgctgaaatggagagaattaaacctcacagaacacttcggaaaattttacaaagaagttattgacaaatgccaatcattcaatcagttggtgtatcaccaaaacgagatagttcagagtttgaagactcacctgcaagttaagaacagttttgcctatcaaccccttttggatttggttgtacagttggcacgagatctgcagatggatttctacccacactttccagagttttttttgactatcacctcgatcctggagactcaggacacagagttgttagaatgggctttcacctcgttatcatatctttataagtacctgtggagactgatggtgaaggacatgtccagtatatacagcatgtacagcacactcctggctcataaaaaactacatataagaaattttgctgctgaaagttttacttttttgatgagaaaggtctctgataaaaacgcacttttcaatttaatgtttcttgatcttgataaacatccagaaaaagttgaaggtgttggacagttgctctttgaaatgtgcaaaggagttagaaatatgtttcactcctgtacaggccaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagaatcgctcttggatctacacacaaaagtaacaaaaactaactgttgtgaaagttctgaacagattaaaaggttgttggaaacataccttatacttgtaaaacatggaagtgggacaaagatacccacgcctgctgatgtctgtaaggtgttatctcaaacactgcaagtagccagtctctccacatcttgctgggagaccctcttggatgtaatttctgctttgatcctgggtgaaaatgtttccttgccggagaccctcatcaaagaaaccatagaaaaaatatttgagagcagatttgaaaaacgtttaattttcagtttttctgaagtcatgtttgccatgaagcagtttgagcagctttttctaccaagctttctgtcatatattgtgaattgcttcttaattgatgatgctgtagtcaaagatgaagctctggccattctggccaagctcattctgaacaaagcagcacctcccactgctggctcgatggcaattgaaaagtaccctctggttttctcaccgcagatggtgggattctatataaagcagaagaagactagatccaagggaagaaacgaacagtttccagtattggaccatcttttatctataattaagttacccccaaataaagatactacttacctttcacaatcttgggcagccctcgtggtgttacctcatattagacctcttgagaaagagaaggtgataccactcgtcaccggcttcatagaggcactcttcatgactgttgacaaaggaagctttgggaaaggaaacttatttgttctttgtcaagctgtaaatactctactaagtttggaagaatcttctgaacttcttcatttggttcctgtggaacgtgtgaagaatttagtattaacctttcccctggagccatctgtgttgctgttgactgatctctattatcagagattagccttgtgtggctgcaaagggccactttcccaggaggctttaatggaattatttcccaagttacaagcaaacatttcaactggtgtatccaagattcggcttttgacaataaggatcctaaaccattttgatgtccagcttccagaatcaatggaggatgatgggctctcagagcggcagtctgtctttgctatattacgccaggcagaacttgttccagcaactgtgaatgattatagagagaagcttcttcatttgagaaaactaagacatgatgtggtacagactgctgtccctgatgggccgttacaggaggtgccgcttcgttatttgttaggcatgctatatattaatttcagtgcactctgggatcctgttattgaactcataagttctcatgcacacgaaatggaaaataagcaattttggaaagtctactatgagcatctagaaaaagcagctacgcatgctgagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaacaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagcaattaattgctcatttgcaagttttctctaaattttcaaatccacgggccttatatctggaatccaaactatatgagttatatcttcagttgttgctacaccaagatcaaatggtgcaaaaaataaccttggattgcataatgacatataaacatcctcatgtcctcccttacagggaaaacttacaaaggttgcttgaagacagaagctttaaggaagagatagtgcattttagcatttcagaagataatgctgtagtgaaaacagcccaccgagcagatctatttcctattctgatgagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagatcagcaagtttatgaaagacaaagaacaaagttctgtactcattacgcttctccttccattcctccaccgtggcaatattgctgaggatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctcctatatgttttaaaagaattacagactactcttgtccgtggataccaggtccatgtgctgactttcaccgttcacatgctgctgcaaggcctcaccaataagctgcaggtcggagatttggactcttgtttagatataatgattgagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaaggtgatcacaggtgctttacagtgcctcatctgggtcttgaggttcccgctaccttccatagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaagcgcttaaatagacaacttgctgccctgatctgtggcttgtttgtggaaagtgaaggagttgattttgagaaaagacttggaactgtccttcctgtgattgaaaaggaaattgatcctgaaaactttaaagatatcatggaagaaactgaagaaaaagctgcagatcgccttctgtttagttttcttacactgataactaaacttatcaaggaatgtaatattattcagtttaccaaacccgctgagactttgagtaaaatctggagtcatgtgcattctcacctgagacatccacacaactgggtgtggctcacagcagcccagatttttggattactctttgcctcttgccagccagaggagcttattcaaaaatggaataccaaaaagaccaaaaaacacctcccagaacctgtagcaatcaagttcctagccagtgaccttgaccaaaagatgaaaagtatctctctcgcctcttgccatcaattgcattccaaattcttggatcagtctctaggagaacaggttgttaagaatttgttgttcgcagccaaagtcttgtatttactggaactttattgtgaggataagcaaagtaagataaaagaagacctggaagaacaagaagctttagaagatggtgtggcctgtgcagatgagaaggcggagtctgacggagaagagaaggaagaggtgaaggaagagctcggcaggccggccacgctgctgtggttgatccagaagctgtcccggattgcaaaactggaagctgcttattcgccgagaaaccccttaaagagaacatgcatctttaagttcctcggcgccgtagcaatggatcttgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagtaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattttgtattttttgtagaaacaggatttcgccatgttggccaggctggtctcgaacacctgggctcaactgatccgcctgcctcggcctcccaaagtgctgggattacaggtgtgagccaccctgctcaaccaggttttattatttaagttagttaaactttggatagattgtataatatatagtttaatgtaatcatgctcatattttttaaataaataaaacactatacta

SEQ ID NO: 198501 - DNA, 3699 bp, Homo sapiens
  Payload ID: 19178
  Gene Name: UTP23, small subunit (SSU) processome component, homolog (yeast)
  Uniprot ID: Q9BRU9
  ENST ID: ENST00000309822
  CDS Start-End: 102-851
gcttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacaggatcagaatttgtctgtgaaagtaaaaaagaagcctggagttcctctcatgtttattattcagaacactatggttttggacaaaccttctcccaaaacaattgcctttgtaaaagcagtggagtcaggtcagcttgtctcagtgcatgagaaagaaagtatcaaacatctcaaagaggaacagggtttagtgaaaaacactgaacagagtagaagaaaaaagcgcaagaaaataagtggtcccaatcctcttagttgtttgaagaaaaagaaaaaggcaccggacacacaatcatctgcttctgaaaagaaaagaaaaagaaaaagaattcggaacagatctaacccaaaagtactttctgagaagcagaatgcagaaggagaatgaatcctttggatactttcaaggacattcaaatgtgaaaatgaattttttacaactagaagtatttataataaaagaccaaacttatttttgtaaatgaacccatatgctttagctaaaattaattataaaataaaaacagtgaccagtctagccagcatggcaaaaccccatctctactaaaatacaaaaattagctgggcatgatggtgcacagttgtaattccagctactcaggaggctgaggcatgagaatcgcttgaacctgggaggcagagattgcagtgagcccagttcgtgtcacttcactccagcctgggcaacagagtgagaacatgtctcaaaaaaaaaataaaaacagtgaatgggtgtaggtgtgatggaattcactttacttactaaatggtttcgggaggttgtttctccaggtaaaattgtcgcctctctggtcccattcccaccttcaaacattatatgcaaacagttttaaaaaatcttacagttctaaaaggcttgtgacaaaaaaagaggcagtccctctttcacattgacagaagaaacttcctctttcaattctagtagttgaagaatttatatttccaaattgtatgattataccgctactttttgatacatcaattatttattgacttcctactagaaagagtgaaattttgcccatttatactgcaccatttttccagtatatgaatattttactctttgtacatcagaaactcagtattttcattattatgactagagtttttttgtttgtttgtttgagttctacttgtccaataaggatgatgattttcttttagatgtaaatgttaacttcaatagcaagaattcaaaaataatattctctttgagattgactgtgaatgttattgaaaagtgtctaaattagtctgaggatcaatgagggtcaattcagttaggaattgaataatgaaacgtgtctctctgaattcccccggcaattgttttagtcatttatcaggccaaaattaaaatgtttttgtactacaagatggaagtataaaattattggacaagtgaaatcgtatcagtagttcctgactgacagcttctggagccacactagagcagtgattctcagtctaacattaggttatcatgatgacgtatgagtaaattcttaatggttaaatgtgagacagttcacatttattcccatagaaatgtcattctcatttgaattcagagatacttctttgctggaagttggaattatagctttacaccaaggagtgacacgtagactaatctggcaagccaaggtagtgtttggattgcaatgtcatgattctattttaaattcttgatggtagaaacatttttaataaggaaggtaaaaatactggaaaaaagtgaatagtgtaggttttgtgaggaaagttaacatttgtcaatgacaagcattaaggccacctaataaagtgtagacaaagtgataaatgaaatatacactgatgatactcatttcaatatgctaaaatacattaaatttaggtattactcttaatctatttctacttagtcagtgctatctgattacctgttaatagcatctgaactggagagctggaaaaatccacttttttatgaagcagtaattatagaagtactaaaaattacaatgtattagtaagtttaatattttgacagggcatggtggctcacacctgtaatcccagcactttgggaggccgaggctggcagatcacaaaattaagagatcaagaccatcctggccaacatggtgaaaccctgtctgtactaaaaatacaaaaattagctgggtgtggtggtgtgcgcctgtagtcccagctactcgggaggctgaggcaggagaatcgcttgaacccaggaggcggaggttgcagtgagccaagatcatgccactgcactccagcctggtgagagagtgaaaccccgtctcaaaaataaataaataaataagtttactattttaaaactggttaatcatttatgtattttgccagtaaaattactttaaaagatattttaacaaaagtctcatatccttgtacttcagtttttttgtgtgtgaatactatccctataccactacccctaaaacctcagaattatttgctttattttttcatacaacttggggaagggaaccatgggagtatgcacatgggatcataatccattctgtggtttggaaaaagaaaatgttaacctctgctttagagggtagctactagctttgttggggataaaagtgtaatacatgcacttttgaactctgaaagtttgccaatctgaaaaggggtgtttctgaagaccactatcttttacgaacacttaaaaataagtgtttgcagttgtgtatgggcacgatactgtattctttacatttttatggccctacagctacttcttatccctgcaagtatataaattaaaaccaagtcactttagaacagctttgaaactagagtttcaaaggtaaaaggatctcatgtttctgaatctgcgtaaagcaagatggctgtgatttgacaggtttaattgctagttttttataggtggatagaaatgaatagtttggagtctttaaaatgttttaaaaaatgtttgcttactatctatatatatgacattattcccaattagttttatatctccaagatatatatatgtatataggtatatacacatatgtatatatacatagtctatatattctatataagaatatattccaataagaatatattccatacgggaatatattagtcattgatgtattttgccggtaaaattaaaagatattttaacaaaagtctca

SEQ ID NO: 198502 - DNA, 796 bp, Homo sapiens
  Payload ID: 19178
  Gene Name: UTP23, small subunit (SSU) processome component, homolog (yeast)
  ENST ID: ENST00000517820
  CDS Start-End: 33-350
ggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagggaacaatggcaaaagcctttgatgaagcattttcctctgagacaacagcggcaatacctgaagaccatgaagcatctgctgagtccttttgttccatcttctttcttcctgatcttgatcgccccctgatgcatcttcatcctgaataaaaatgacccccaaaaagctgacaaaacaagtccaatgaaaaatgaagtatttctacatctcctaaaagctcctaaattaccttgagattgtgtattttgaactaatagaaaactgtacttaatgctgctgagcaatcacttagcatttagagtacaaactgaagagtctgtttttcttaaattacaaggcaaagtcctctatgtgcaagcaaacatttggctgaaagtatgcttctatattgcgctataaggatgctatctacacacactatgtggtctgtggactgctgctgatcatggaggttttggttactggcccctcttaaagaacttcaggatataaatcaactgtaccactaaatatactgtttatttcaactaaatatacatacataaatattgcaacatgattttctagatgactaa

SEQ ID NO: 198503 - DNA, 833 bp, Homo sapiens
  Payload ID: 19178
  Gene Name: UTP23, small subunit (SSU) processome component, homolog (yeast)
  ENST ID: ENST00000521703
  CDS Start-End: 100-342
ttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagtatatcccaagaatgtacacattctgcaccaattatggaggacaacagtatgtgattgatgctctgattggctagctctggaccacatgaccaactctgctctggtggtagagctaattccacttaaaccacatcaacagagaatggggaacaatggcaaaagcctttgatgaagcattttcctctgagacaacagcggcaatacctgaagaccatgaagcatctgctgagtccttttgttccatcttctttcttcctgatcttgatcgccccctgatgcatcttcatcctgaataaaaatgacccccaaaaagctgacaaaacaagtccaatgaaaaatgaagtatttctacatctcctaaaagctcctaaattaccttgagattgtgtattttgaactaatagaaaactgtacttaatgctgctgagcaatcacttagcatttagagtacaaactgaagagtctgtttttcttaaattacaaggcaaagtcctctatgtgcaagcaaacatttggctgaaagtatgcttctatattgcgctata

SEQ ID NO: 198504 - DNA, 369 bp, Homo sapiens
  Payload ID: 19178
  Gene Name: UTP23, small subunit (SSU) processome component, homolog (yeast)
  ENST ID: ENST00000520733
  CDS Start-End: 133-327
agatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacagggaacaatggcaaaagcctttgatgaagcattttcctctgagacaacagcggcaatacctgaagaccatgaagcatctgctgagtccttttgttccatcttctttcttcctgatcttgatcgccccctgatgcatcttcatcctgaataaaaatgacccccaaaaagctgacaaaacaagtccaatgaaaaa

SEQ ID NO: 198505 - DNA, 563 bp, Homo sapiens
  Payload ID: 19178
  Gene Name: UTP23, small subunit (SSU) processome component, homolog (yeast)
  ENST ID: ENST00000517814
  CDS Start-End: 97-563
atttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacagtggatctctgctagcttactaatgctcactgtccaccacctcatgcagtcagaaagatgccatctgttctcttcagctgccaaagtgtcacaggttacccacag

SEQ ID NO: 198506 - DNA, 683 bp, Homo sapiens
  Payload ID: 19178
  Gene Name: UTP23, small subunit (SSU) processome component, homolog (yeast)
  ENST ID: ENST00000521071
  CDS Start-End: 96-305
tttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagtggatctctgctagcttactaatgctcactgtccaccacctcatgcagtcagaaagatgccatctgttctcttcagctgccaaagtgtcacaggttacccacagtatatcccaagaatgtacacattctgcaccaattatggaggacaacagtatgtgattgatgctctgattggctagctctggaccacatgaccaactctgctctggtggtagagctaattccacttaaaccacatcaacagagaatgggtaagatgtgtttcctcaagggagactgtaacactattagaaggaggagtgaaagttggcgtgtaagaagcaaatgatcactactgatatgtgggcatttgaggtgaattaaatttttacttgaattattttatgttttcatactcatc

SEQ ID NO: 198507 - DNA, 620 bp, Homo sapiens
  Payload ID: 19178
  Gene Name: UTP23, small subunit (SSU) processome component, homolog (yeast)
  ENST ID: ENST00000524128
  CDS Start-End: 133-336
agatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacagtggatctctgctagcttactaatgctcactgtccaccacctcatgcagtcagaaagatgccatctgttctcttcagctgccaaagtgtcacaggttacccacagtatatcccaagaatgtacacattctgcaccaattatggaggacaacagtatgtgattgatgctctgattggctagctctggaccacatgaccaactctgctctggtggtagagctaattccacttaaaccacatcaacagagaatggggaacaatggcaaaagcctttgatgaagcattttcctctgagacaacagcggcaatacctgaagaccatgaagcatctgctgagtccttttgttccatcttctttcttcctgatcttgatcgccccctgatgcatcttcatcctgaataaaaatgacccccaaaaagctgacaaaacaagtccaatgaaaaa

SEQ ID NO: 198508 - DNA, 2073 bp, Homo sapiens
  Payload ID: 19179
  Gene Name: UTP3, small subunit (SSU) processome component, homolog (S. cerevisiae)
  Uniprot ID: Q9NQZ2
  ENST ID: ENST00000254803
  CDS Start-End: 200-1639
aatcgtacgccacgcggagagcatgctgggggccggaaggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaactaaagtcattgtattaatatataatactttaaattttaaaaattcttgtccacaaggaaatttgtctgggttattggacaatttataagaactatgggagcaatatgaaggtgcttgagaaaagagatgatgttgaagttttccaatattctgttgaagttttccaatattaagtattagcttagggaaatttcacagttcattgtggagtgttaaacttagaacatgtgtaacttttcacataaagagaatgcatctttgacagttatcttatttgtaaggcagcctataaaatagttctgaagtattttatttacctaactataattattgggccagatacttgttaataaatgggcttaatgttaacatgga

SEQ ID NO: 198509 - DNA, 4392 bp, Homo sapiens
  Payload ID: 19180
  Gene Name: UTP6, small subunit (SSU) processome component, homolog (yeast)
  Uniprot ID: Q9NYH9
  ENST ID: ENST00000261708
  CDS Start-End: 139-1932
ggaaaaggcgggacctagggagcacgttacgtccggacgcgtcggtggtagggctgggtctccgaacctgaaaccgggagcttcctgctcgtgttcgctgttgagaagctacccgcggggttgtagacctcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgagactgggtcttgctctgttgccctggctggtcttgaactcctggactcaagtgaccttctcacctcagactcctgagtagctgggattataggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctctaatctcgacctaagagccagttaaaatgaaggagaaagtggccaggcatggtgactcaacgcctgtaatcccagcactttgggaaggctgaggcaggcggatcacctgaggtcaggagtttgagactagcctggccaacatggtgaaaccccgtctctactaaaaatacaaaaattagccaggtgtggtggtgggtgcctgtaatcccagctgcttgggaggctgaggcaggagaattgcttgaacctgggagacggaggttgcagtgagccgagatcatgccattgctactccatcctgggtaagaagagcgaaactccttctcaaggaaaaaaaaaaaggagaaagtacagttttgttggtttattctcattataaaagatacgtggtatgcatttgttctggaaaatatggaggaaatagaatagtgtggtaaaaaaaagcatcctgtcactgggagaagctttcagtgtagcttattgttacgtttcacttagtattgtttttctgtgtcattaaatagccttaaaaacatttaatgaattcgtaacattacattgtaaaaatgagccataatatattttactaatcctctggttagactgtctttttttttttgagatggagccttgctctgtcatccaggctggagtgcagtggctccatctcggctcactgcaacctccacctcccgggttcaagtggttctggctcagcctcccgagcagctgggtgggattacaggcacccgccaccgcgcccagccaatttttgtatttttagtagtgcgggggtttcatcatattggccaggctggttgcgaactcctgacctcatgatccacccgccttggcctcccaaagtgttgggattacaggcgtgaaccactaagcctggcctggactgtcatttctaatttttttaaaaattagataaatgctgttgatgaagattcttgtcaatctttgttcacatccctggccatttccttaggagattgacatccgacagtggaattactggatcaaaggatactgcttttagagaatactgatatgtattgctggtttgctccttctttcaagcaatacatgaaagtgtcagtacccttacctgtactggtgtaattatatcttttatttttaccattttataggtgaaatgtgatatgtcattgttttaccatactttgatattagtgaagttagtgtattttatgtttctcatctttttacatccttagactatttaaaaattttttttcttactaatttatgagttaatttttttttttaaattggacaagttcttgctttgtcacctaggctagagtgcagtggtgtgatcatggctcactacagccttaacttctgggctcaagagatcctcccacctcagcctcttgagtagctgggactgcaggtgcacaccaccatgcctggttaatttaaatttttttttgtagagactggtcttgctatgttgccagggctggtctcttaaacagttgggctcaaacaatcctcctacctcaacctcccaaagtgctggtattataggcatgagccattgtgcctggccagagtttttaaaaacatattcagaatattaatatcttgtttctcatttgttgcaaataattttacccccagccttgtttgtggtgattttttttttttgagacagagtcttgctctgtggtccaggctggagtgcagtggtgtggtcttactgcaacctctgcctcctaggttcaaacagttctccctgccaaagcctcccaagtagctgggattataggcaccttttgtggcgatttttgatgcccagaggtattttgtgtgtgtatgtgtgatgtctgtttttaaaatgctttggaagctcttcctggtgctgagaacaactctttttccccaagcagttaattttgccaacactatttgggcagttatgtttctctctgctgatttgtgatgttacctttattatatattaaatttctatgagtattaga

SEQ ID NO: 198510 - DNA, 563 bp, Homo sapiens
  Payload ID: 19180
  Gene Name: UTP6, small subunit (SSU) processome component, homolog (yeast)
  ENST ID: ENST00000581012
  CDS Start-End: 1-184
cagagctgtgtttaaaagtttacaggagagccgaccattttcagttgactttttcaggaaaatgattcagtttgaaaaggagcaaacggagtctctctctgtcgcccaggctggactcttggctcactgcaacctctgcttcccaggaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattga

SEQ ID NO: 198511 - DNA, 410 bp, Homo sapiens
  Payload ID: 19180
  Gene Name: UTP6, small subunit (SSU) processome component, homolog (yeast)
  ENST ID: ENST00000579459
  CDS Start-End: 1-88
tttacaggagagccgaccattttcagttgactttttcaggaaaatgattcagtttgaaaaggagcaaatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattg

SEQ ID NO: 198512 - DNA, 753 bp, Homo sapiens
  Payload ID: 19181
  Gene Name: utrophin
  ENST ID: ENST00000367524
  CDS Start-End: 1-753
agattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaa

SEQ ID NO: 198513 - DNA, 579 bp, Homo sapiens
  Payload ID: 19181
  Gene Name: utrophin
  ENST ID: ENST00000367525
  CDS Start-End: 382-579
aactctaagcttggggccctggagagaacagttgtggcctgcaggtcattagtgaggtgagcagaagggaatcctggacttcccagagaaagaggagaccatgccagcctcgtggaacacagctaccaggaaatacagaagcaggtctattccttgcgaactccgaagtccatgaaaaaacggacccacagtggggtggctaaaatgtcccagcgcaagctgccgctgctgctgatggaccatagctcaagggcaaggcttgtaaaggattttacaaaggattttaaagtatagccagaaaagatacggtgtttagaagttaaacgctgttgtctgaaggaagtttgccggaaagatgtaggcttcaagggctactggacaatgattggtctgaacttcaacttacgggaactgctgacaaaatttgaaaaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgac

SEQ ID NO: 198514 - DNA, 3220 bp, Homo sapiens
  Payload ID: 19181
  Gene Name: utrophin
  ENST ID: ENST00000367526
  CDS Start-End: 248-3214
caacttccttcatttctggccatgccgggctgagcaagtgctgcctgtgagcatctgctggggggctttctctgtggcgtttgtctgtgttttttaaattgagaagttgaaggaataccagcctcctttttcctagaacctaaccccctgtatctttcaaatgctttcctggaaacgagcatgctcagagaactgacaaatcattgtccagtgaccgggaggaaatgatcgttgctcttcatttataatgcaaattctgaggtgtctccagaagtgtggtaaacttaaaatgatggctgtggtgagaacgtctctgcagaaagttgtggttttgttgcatcgcttacaaaggatggcagtttcttctcctcggtatcagaagctctgtaaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtatt

SEQ ID NO: 198515 - DNA, 12339 bp, Homo sapiens
  Payload ID: 19181
  Gene Name: utrophin
  Uniprot ID: P46939
  ENST ID: ENST00000367545
  CDS Start-End: 1-10302
atggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaa

SEQ ID NO: 198516 - DNA, 633 bp, Homo sapiens
  Payload ID: 19181
  Gene Name: utrophin
  ENST ID: ENST00000455022
  CDS Start-End: 74-633
gtgaagtagagtgagcattagcctggcagacagctagggtaatagatgacttccagtggaagtcaaagcacaaatgttggaagaagaagaatggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaag

SEQ ID NO: 198517 - DNA, 354 bp, Homo sapiens
  Payload ID: 19181
  Gene Name: utrophin
  ENST ID: ENST00000433557
  CDS Start-End: 214-354
caccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctgatgaacacaatgacgtacagaagaaaacctttaccaaatggataaatgctcgattttcaaag

SEQ ID NO: 198518 - DNA, 572 bp, Homo sapiens
  Payload ID: 19181
  Gene Name: utrophin
  ENST ID: ENST00000421035
  CDS Start-End: 111-572
aaaaaaaaaacccaaaataacacaggacatcccagtgtgcagttcgaaggctgcttttgttgtccacttcctccacatctttttcctcatcatctaagcagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcag

SEQ ID NO: 198519 - DNA, 666 bp, Homo sapiens
  Payload ID: 19181
  Gene Name: utrophin
  ENST ID: ENST00000432686
  CDS Start-End: 125-666
aagattatgaagcaacaacactagctacagtttaaatgaaggcatttcttcacttttaatatatttcttttttcaccagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgt

SEQ ID NO: 198520 - DNA, 678 bp, Homo sapiens
  Payload ID: 19181
  Gene Name: utrophin
  ENST ID: ENST00000417142
  CDS Start-End: 125-678
aagattatgaagcaacaacactagctacagtttaaatgaaggcatttcttcacttttaatatatttcttttttcaccagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggaga

SEQ ID NO: 198521 - DNA, 597 bp, Homo sapiens
  Payload ID: 19181
  Gene Name: utrophin
  ENST ID: ENST00000628146
  CDS Start-End: 148-597
atactgtttggccctgtttttcaatttgactccatcaaagcacattctccagccgaggggtacacatccctttgtgacttcagaaatcatgcactgttggtttgggagtcttaactacatttggaggacacgctgagccgacgagaaatggaagtgagatctgaatccacaaacggagacggcagacagtcacaggcagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgg

SEQ ID NO: 198522 - DNA, 4123 bp, Homo sapiens
  Payload ID: 19182
  Gene Name: UV radiation resistance associated
  Uniprot ID: Q9P2Y5
  ENST ID: ENST00000356136
  CDS Start-End: 242-2341
aatgagcgctccgggtctcagcggggtggaggggttgcactgcggtaatatggctcttccttagccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcagcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttgccctcaccatggtttataaaactttgggaaaacggaatattcagaaataggtttccgccatgtactgaaaggtctgtggccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtccagttgtcattcccgcattcagatttcatttgctgttgctttatacgttacgtacccaaggacattgcctcagggttgcaaactctttaaaggaaaatttatccatatatccatgtattatatagaagaataaaaattgagtttacttcacccgacctgatttttttttaccagcttggaaattcctcttgaacctacgtctccatatgtcacatcatgacaggactagcctgaacaaaagccatgtctatctaagcggaggctgttgacttcattcagtttgcatattgtatatagcaacacaaacacttgacaggtatatactccagtcgccacatttgtcctgcataacagcttcactcacaggcctcaccgtcactttattttgtgtccaagcattcctgggctcaagtttaatgtatagctacattgttgttttccatgtagagaactcacaggatgactacatcacaaataaacccaactctcaggcagtcgaaagctttaactggatctgcagaagcccatcttcctccacatgaagaagtggggctccttcacctagagcaggagcttctctgcagtgtactgtctgtcgctcattttggagtcagtgtgggtggagacagcatcgtggatatgcacgtgctgcggggccctccagggaagtaacatttaccaaaaaaaaagaaaa

SEQ ID NO: 198523 - DNA, 1823 bp, Homo sapiens
  Payload ID: 19182
  Gene Name: UV radiation resistance associated
  Uniprot ID: Q9P2Y5
  ENST ID: ENST00000533454
  CDS Start-End: 753-1736
actacccacaagaggtggtgaaaacgatctctggtataaagcaaatggaaaaggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaaggcatgatttcttggaaaggagagtccatatgtcaaacaatgtctcattgagaacatggaatgattccatagatgctgtggcagtgattagagtcttaaatattttgtcctgtctggatcagtgggtgcttggttccttaacaaatcagctgcctcagtgattgggaaggcaggatgcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgac

SEQ ID NO: 198524 - DNA, 1325 bp, Homo sapiens
  Payload ID: 19182
  Gene Name: UV radiation resistance associated
  ENST ID: ENST00000525183
  CDS Start-End: 1-273
aattctattttttcaccttcacagctaagatatcaacatggactagggactccagacttgcggcaaacccttcccaacctgaaaaacttcatggagcatggactaatggtcaggtggacatctgctttacaagaacacagcaaactaagaaagggtatagtggccactgcgggcaggggcactgattcaaccacccacagcgccagaggggactcgaagaacccacgccaggcttacctccagacctgcgtcctacagaacagacaccactgaacatcctgtagtccccttattgtgtcatcgctcagtaatgttcatatcagtggcccagaggcaacgagaaaatgccttttcttgttcaacttttttaagatgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttg

SEQ ID NO: 198525 - DNA, 511 bp, Homo sapiens
  Payload ID: 19182
  Gene Name: UV radiation resistance associated
  ENST ID: ENST00000528264
  CDS Start-End: 116-511
acatcccagacgatgggcggccaggcagagacgctcctcacttcctagacggggtggcggccgggcagaggctgcactctggaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactg

SEQ ID NO: 198526 - DNA, 3152 bp, Homo sapiens
  Payload ID: 19182
  Gene Name: UV radiation resistance associated
  Uniprot ID: Q9P2Y5
  ENST ID: ENST00000531818
  CDS Start-End: 931-1914
cagttcgagcttctgggcagctttgtttacctgctcaagcctcagcattggtgggcgcccctcccccagcctcgctgccgccttgcagtttgatctcagactgctgtgctagcagtgagcaaggctccgtgggcgtgggaccctctgagccaggcgcgggatataatcttctggtatgctgtttgctaagacctttggaaaagcacagtattagggtgggagtgacctgattttccgggtgcgattttccaggtgccgtctgtcgtggcttcccttggctgggaaagggagttccccgaccccttgtgcttccctggtgaggcgatgccttgccctgctttggctcacggtccgtgggctgcacccactgtcctacaagccccagtgagatgaacccggcacctcaattggaaatgcagaaatcatccatcttctgcgtcgctcacgctggaagctgtagactggagctattcctattcggccatcttggaacctccctgcctcttttttctgaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttgccctcaccatggtttataaaactttgggaaaacggaatattcagaaataggtttccgccatgtactgaaaggtctgtggccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtccagttgtcattcccgcattcagatttcatttgctgttgctttatacgttacgtacccaaggacattgcctcagggttgcaaactctttaaaggaaaatttatccatatatccatgtattatatagaagaataaaaattgagtttacttca

SEQ ID NO: 198527 - DNA, 2463 bp, Homo sapiens
  Payload ID: 19182
  Gene Name: UV radiation resistance associated
  ENST ID: ENST00000528420
  CDS Start-End: 286-2082
agtgctcagctcccttgccatgcgataccctgcaagtcctcaccagcaaaaaggctctcaccagaggctgcccctcggcctgtgttatcagattttttgcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttg

SEQ ID NO: 198528 - DNA, 1831 bp, Homo sapiens
  Payload ID: 19182
  Gene Name: UV radiation resistance associated
  Uniprot ID: Q9P2Y5
  ENST ID: ENST00000532130
  CDS Start-End: 478-1461
tttagtagaattcactgtgaaaccaactagaccttttttttttctcccctgtttctgaagaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctc

SEQ ID NO: 198529 - DNA, 6939 bp, Homo sapiens
  Payload ID: 19183
  Gene Name: uveal autoantigen with coiled-coil domains and ankyrin repeats
  Uniprot ID: Q9BZF9
  ENST ID: ENST00000322954
  CDS Start-End: 187-4437
aattggctacgggaggggagccccgcctcaggcctgtcgacgtctgctgcccggggcccgcaggtggcaggcaggtggggctggtacagcccgcgccgcctctgctgcagccgctgccgtctactccttgcgcgctggcactccgcagcctttaaggttcgcgcgggggccaggcaagagttagccatgaagagcctcaagtcccgcctgaggaggcaggacgtgcccggccccgcgtcgtctggcgccgccgccgccagcgcgcatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactttgccctggattgactacatatttttaaaccttcaagtccctaataaaacatgagccatctgagtgagtccatatgaagcgaggttaggctgaaataattgcttaaagatgtctttcagagaaattaatttggttggtggccacttttaggtggatcaaaagacctttcagatcctcagaaccttgagacataatacagttgtgaggaatgtgttgtaacttggctggccaagttacatgttacagtatctttactgaggtaacttcattagtgtctttggccttttttgtaggtatagatattttttctttttacactaataacttttatgccttttaaaataaatttattttcataaatggtttgcagtgctaaattacatttagattaagaacaggcaggggtggaatatatcaggaatttataataaaattgccttaatctctacaacagtatcttaatttttacttgcggtgactattcttgccacaatattggagaataatgatagatgatatactagatttttcaaagtgtgaaaacctttagactttttttagcaattagtttgacattcgctactatagtaaccaagcactcattatatatgcatcctccaaatgtttcatgcttatttataggaaagttatattaatgagattaataatgtgaaatacagttttcctgcaaaattagcattagagaattgattttagataacagatttttaaagttttagagaaaagtacagtaatacagtaaactgaaagagtatatagatagcaataaaataacataagtggacatgtttatagtaaatactctgaagtaaacaaccgtttttattaactgcatctcattagggaaagtttatatgtcttgttattttttattaacattttatttaccattcagagtgaaaattactaatttgagtattaacaaataactgaataaatggatcattacagttaggttttctcaaattgcaaaatttgccttagcaattatctttgaacatcccgaaccagatttttaaatcccatttttgtttaatagggtaaaaataccatcaaaatgacttctcataccaaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaataaaaaataaaatataaattaaaaaagttgccgggggtggtggctcatgcctgtaatcccagcactttgggaggctgagggaggtagatcacctgaggtcagaagttcgagaccagccttaccaatatggtgaagccccatctctactaaaaatacaaaaattagccctgcatggtggcaggtgcctgtagtcccaggtactcgggaggctgagacaggagaatcgcttgaacctgggaggcggaggttgcagtgagccaagatctcgccactgcactccagcttgggcaatagcaagactccatctcaaaataaaataaaataaaacttagagcaaagtttaaaactgagtattcatattaagtgttttattttccatattagagatgggaagggaaccttatgtgtattttattttgttttcaaccatcaataaagttttctctagaatattgttttgaacatccttgtaaaagatttgcgagttaaactattttatttactgtctgtgagagcattgggagtaggaaacgatggactccaaagtacaagggagaatacccattttcattcagctatctggagtaaaatatcaagtacttccttcaactaatcttgtctcattcactcaccttttgatatcgaaggcagaaattgcgtttacaacactgaagaccaaagctttttaattagtaaacaagcggaacatagataatggacaatgctggccactgccattctgtgttcagaaagactatgagacctgaacatatggccaagaggaaagaagagtgacgttgtctaagatgtaatgagtgctctctgagagaatcactcaattcctattggagtgcaatccttacttgagaactttattactcttgttctgtgtagttttttttttttgtcacttccccatcagaaaagcatattctttttgatagagggtcagtgttataaataattgtcttttgaaataaaatcaaatattcatgcattgaa

SEQ ID NO: 198530 - DNA, 4859 bp, Homo sapiens
  Payload ID: 19183
  Gene Name: uveal autoantigen with coiled-coil domains and ankyrin repeats
  Uniprot ID: Q9BZF9
  ENST ID: ENST00000379983
  CDS Start-End: 394-4605
atcatgcactgcagcgtctgtgttgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactttgccctggattgactacatat

SEQ ID NO: 198531 - DNA, 4026 bp, Homo sapiens
  Payload ID: 19183
  Gene Name: uveal autoantigen with coiled-coil domains and ankyrin repeats
  ENST ID: ENST00000539319
  CDS Start-End: 24-3947
cgggggccaggcaagagttagccatgaagagcctcaagtcccgcctgaggaggcaggacgtgcccggccccgcgtcgtctggcgccgccgccgccagcgcgcatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtacgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctggg

SEQ ID NO: 198532 - DNA, 749 bp, Homo sapiens
  Payload ID: 19183
  Gene Name: uveal autoantigen with coiled-coil domains and ankyrin repeats
  ENST ID: ENST00000560167
  CDS Start-End: 73-749
gaaacaattttcacaaatgtgtctttttagaggaagtgtaaattattctcatgctattgtggtaatgagaacatggttaaaaaacaacaacaacagccaccacaaaaaaaccaccctgaatttgcaccggccttgcatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgc

SEQ ID NO: 198533 - DNA, 2060 bp, Homo sapiens
  Payload ID: 19183
  Gene Name: uveal autoantigen with coiled-coil domains and ankyrin repeats
  ENST ID: ENST00000558758
  CDS Start-End: 367-2060
gtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataa

SEQ ID NO: 198534 - DNA, 4723 bp, Homo sapiens
  Payload ID: 19183
  Gene Name: uveal autoantigen with coiled-coil domains and ankyrin repeats
  ENST ID: ENST00000560441
  CDS Start-End: 394-4599
atcatgcactgcagcgtctgtgttgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctat

SEQ ID NO: 198535 - DNA, 4560 bp, Homo sapiens
  Payload ID: 19184
  Gene Name: UV-stimulated scaffold protein A
  Uniprot ID: Q2YD98
  ENST ID: ENST00000389851
  CDS Start-End: 448-2577
gccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccaggcacgccgcggtgctcggccctgggtatccgggcaggctgcctccgttagggccgcccctgctctccggacgcgacttttcattggtctcagaatttcttggctcctcttggcctctgcagccttgctggaggctgccctgcggaatctgaatatggatcagaaactttcgaagttggtagaagagctcacaacttcaggagaaccccgactaaatcctgagaaaatgaaggaactgaagaaaatttgcaagtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtggattttcaagacacgaatgctcggagtctggcagaaaggaagagagaagaggagaagcagaagcacttggataaaatttatcaagaaagagccagccaggcggagagggagatgcaagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcagagggcctgaaggtgcaggagaacgaggacaaccttgctctcatccacgccgcccgcgacacactcaagctcatccggaacaagttcctgccggctgtgtgctcgtggatccagcgcttcacccgcgtcgggacccacggtggatgtttaaagcgtgccattgacctgaaggctgaattggagctcgtactgagaaaatacaaggagctggacatcgagcctgagggaggggaaaggcgcaggacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgttcagtcatctgctttctgtttctggatgtgccttttcatacatgtgtcctcttgtccctggcttcttacacttggcgttgtttttaaggtttatccatgcagttcccctccaatgtataaaacaaaggaggtgaaaacctgtccatgcggaagcttgtgcacccatgttcacagcagcattggagaaggataccgaacatcttctcgtgggcttactggccatttgtgtatctcctttggagaggagtctattcaaacctcttgcctatttttaattgaatgatttatcttgagttgtaacagttgttttttttgtttttccttttagagatgggcttttgctcttacccaggctgagtgcagtggcagaatcatagctcagtgcagcctcaaactcctgggctcaagccatccttccacgtcagcctcccaggtagctgggactacaggcacacaccacaacacctggctaattttttaaattttttgtagagatgaggtctcactgtgttgcccacggtgatctcgaactcctagcctcaagcgatcctcctgcttcggtctcccaaagtgttgggattacaggcatgagccaccactcctggccaggagtttatatgtatactgtggatactagatcctcatgtgatttgcaaaaactttatttatttatttatttatttttgaaatggaatcttgctctgtcgccaggctggagtgcaatggcgtgatctcggctcactgcaactaccacctcctgggttcaagcgattcgcctgcgtcagcgtcctgagtagctgggactacaggcgcgcaccaccacgcccagctaatttttgtatttttagtagagacgggatttcactgtgttggctgggatggtcttgatctcttgacctcgtgatccacccacctcggcctcccatagtgctgggattacaggtgtgagccaccgcactcagctgatttgcaaaaactttcttccatactgttgtttcactttctggatagtgtcctctgaagcacaaaagttaattttgatgaagtacagcaatttatctgtttttttcttttgttgcttatgcttttgctgtcacatttcagaagccatcacctaatccaagatcacagagatttacacctagtttctaataagcattttataatttcagctcttatgtgtagatctttgatccattgtgaattaagttttgtgtgtggtgtaagagcccacattcttttgcatgtggatatccagttgtcccagcaccatttgttgaaaacattatttttccccattgaattatcttcgcaccattattgataatcagttgaccaaaaatgtacaggcttatttctgggcacttgactctattccattgacctgtttaaccttatgccagtgccacagtgccttgatcagtgctgctttgttgtgagaagttttactttgttctgcttcaaggctgttttgactcttctgcatctcttgcatttccaaatgaattttaggatccactcatcagtttcttc

SEQ ID NO: 198536 - DNA, 2597 bp, Homo sapiens
  Payload ID: 19184
  Gene Name: UV-stimulated scaffold protein A
  Uniprot ID: Q2YD98
  ENST ID: ENST00000507531
  CDS Start-End: 185-2314
tcttggctcctcttggcctctgcagccttgctggaggctgccctgcggaatctgagtgaataagggaaacagcaacagtcacgttggggaaaagctgattcggacagcgccactggttcctttaacgcacgaccctcaatgcagcgtcccacacacgggattgtagaggtcccgagtttaagatatggatcagaaactttcgaagttggtagaagagctcacaacttcaggagaaccccgactaaatcctgagaaaatgaaggaactgaagaaaatttgcaagtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtggattttcaagacacgaatgctcggagtctggcagaaaggaagagagaagaggagaagcagaagcacttggataaaatttatcaagaaagagccagccaggcggagagggagatgcaagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcagagggcctgaaggtgcaggagaacgaggacaaccttgctctcatccacgccgcccgcgacacactcaagctcatccggaacaagttcctgccggctgtgtgctcgtggatccagcgcttcacccgcgtcgggacccacggtggatgtttaaagcgtgccattgacctgaaggctgaattggagctcgtactgagaaaatacaaggagctggacatcgagcctgagggaggggaaaggcgcaggacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgag

SEQ ID NO: 198537 - DNA, 4819 bp, Homo sapiens
  Payload ID: 19184
  Gene Name: UV-stimulated scaffold protein A
  ENST ID: ENST00000503548
  CDS Start-End: 1-409
cccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagactttccacagctgcccaagaccttccggctccagaggagggacggagccatccccacgtccctgtggctctcaggacgccctcctctgaggggcgcgtgattccagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaagtaagagtggctgctgggtcacctcccaccgcgtggcccccccgtgtgagggtgttcgaggggggccatctgagcgccaagatattccagggacttggggcctccaggggctcccctgctttgagttcccctgggggaccacccagcctttccccggggaggggcagtgccagccagcaggggcagcaggcaggtctgctcaggaacgccccccagcattccccaggataagaggggctcgaccgccaggcaccgccatcctcgcttcctgggggagccatgccaggacacaggccttggctggtgcagagtgagcccctcgtctctcccttgcctggctgtacccccaggtcagtgcctgcgtatttctgcagcggtgacttcagggagggcgatgactgcaaaggcgggcagaacgggggtccacgcgtcagccccagcagagcccagccccagcatgtcttctctgagcactggctctgggaggctggcctggtgtctctgcagcccagcatgggcctgtgtgactggtgaggacttggcagggccagagtgcgaagcccaccagcccggcgtccctgcgtgcagtctgtcagctggggcaccagccactcgcacggccttgtgtttctgtcttcatattgccttgttctcgcctaagaaaatccagaatgcttgtttagaagccacctgaggctgttgactccctcccaaatctgtgtcaagtccctgctggtgcaggtttgtctggtagcaccagtgaggtggcccccacccatcgccatcccagaaaccctcccttggacacacctggaaggtgctaagtgcaccgggcagaggaggcccctcctggccagcatgaccgtgcaccggcctgagtgggctcgggtgggaggcgccttcacagcactcagaccaggcttcccccaggcttgtgggtggtacatccacagccttgcttgggtggggcaggggcgctggtgggggctgtggagaggctgcctggggcccctggcacagggctggacccatcccgtatgccagccacccaaggcaccttagcccttggagctcagggtgaggctgttttcccgtggatcagccaggggcagaggccagccttggtgctgatgcccaggaggaggaatggccagtgggcccatgccaggcctcctccctgtgtctcatggggacactgaagcccatggcaggagctggctcttcgccacagctgtgtggcccagacccctccctacagaaaggatctggggtgaccacaggcaaaaccctgcctcgaggggcccccacagcagcgcctggcagccccacaggggccgcagctgagcggcagcttcaccacattgtggcctcaggccctgctggctccacagctccacaccctcgtgggtcgcagcagctgagctggtcagcacagcacacctcatcctgctccccggaatgcctgcctggcccgtgccccccctgctgcagccctccaggtttccagccctggccgtggagccgtgcgtgcagcagcgggcagggctgtcctgacgcctcctggctgcatctcctgcgaggccgctccccgggaggccaagggggaggctgccctcatcctggagtgcgggaggccacgggagaagtgccaaggtggggctggggccaccttcaccgcgcagaaccacccgccgcagactccgcttctgggacctggggcggccctttctaagcctgtctgtctcgggccagggccaaggggcccgtcgcccatctgtctctgaaggtggcacccacaggcagtctgtcagtgtccgagggcagcagttgccccaggaccagtgcctaactttggtgatgccgccactgggagcccaggcccctggcggaagcctcccaggtcacatcttgccttgtttccccacagggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgttcagtcatctgctttctgtttctggatgtgccttttcatacatgtgtcctcttgtccctggcttcttacacttggcgttgtttttaaggtttatccatgcagttcccctccaatgtataaaacaaaggaggtgaaaacctgtccatgcggaagcttgtgcacccatgttcacagcagcattggagaaggataccgaacatcttctcgtgggcttactggccatttgtgtatctcctttggagaggagtctattcaaacctcttgcctatttttaattgaatgatttatcttgagttgtaacagttgttttttttgtttttccttttagagatgggcttttgctcttacccaggctgagtgcagtggcagaatcatagctcagtgcagcctcaaactcctgggctcaagccatccttccacgtcagcctcccaggtagctgggactacaggcacacaccacaacacctggctaattttttaaattttttgtagagatgaggtctcactgtgttgcccacggtgatctcgaactcctagcctcaagcgatcctcctgcttcggtctcccaaagtgttgggattacaggcatgagccaccactcctggccaggagtttatatgtatactgtggatactagatcctcatgtgatttgcaaaaactttatttatttatttatttatttttgaaatggaatcttgctctgtcgccaggctggagtgcaatggcgtgatctcggctcactgcaactaccacctcctgggttcaagcgattcgcctgcgtcagcgtcctgagtagctgggactacaggcgcgcaccaccacgcccagctaatttttgtatttttagtagagacgggatttcactgtgttggctgggatggtcttgatctcttgacctcgtgatccacccacctcggcctcccatagtgctgggattacaggtgtgagccaccgcactcagctgatttgcaaaaactttcttccatactgttgtttcactttctggatagtgtcctctgaagcacaaaagttaattttgatgaagtacagcaatttatctgtttttttcttttgttgcttatgcttttgctgtcacatttcagaagccatcacctaatccaagatcacagagatttacacctagtttctaataagcattttataatttcagctcttatgtgtagatctttgatccattgtgaattaagttttgtgtgtggtgtaagagcccacattcttttgcatgtggatatccagttgtcccagcaccatttgttgaaaacattatttttccccattgaattatcttcgcaccattattgataatcagttgaccaaaaatgtacaggcttatttctgggcacttgactctattccattgacctgtttaaccttatgccagtgccacagtgccttgatcagtgctgctttgttgtgagaagttttactttgttctgcttcaaggctgttttgactcttctgcatctcttgcatttccaaatgaattttaggatccactcatcagtttcttcaaaaaaaaaaaaaaagcagctgagatttttgataggaattacattaaatctagagattgctttggaatgtattaccgtcttaatattaaatcttctgagtcatga

SEQ ID NO: 198538 - DNA, 1494 bp, Homo sapiens
  Payload ID: 19184
  Gene Name: UV-stimulated scaffold protein A
  Uniprot ID: Q2YD98
  ENST ID: ENST00000511563
  CDS Start-End: 415-1197
gtggttttaacatagactctaaacagcccccagcacaggggcagtgcagaggtggtgtgattttggggaacaagaacagccttggagacgatcttaaatgcagtccaaccgtggctgatgttggagccctaagcaggggaaaaagctccacaagaaataggaatttccagggctctgcccaccgggagctgtgttcatacacagggtctgggggttgatttgtattggggtgtttttccacagacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcg

SEQ ID NO: 198539 - DNA, 2927 bp, Homo sapiens
  Payload ID: 19184
  Gene Name: UV-stimulated scaffold protein A
  Uniprot ID: Q2YD98
  ENST ID: ENST00000511216
  CDS Start-End: 347-2476
cgcgccggttcggtccccggggctctgcgggcgccgggcagagacctgcggccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccagatatggatcagaaactttcgaagttggtagaagagctcacaacttcaggagaaccccgactaaatcctgagaaaatgaaggaactgaagaaaatttgcaagtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtggattttcaagacacgaatgctcggagtctggcagaaaggaagagagaagaggagaagcagaagcacttggataaaatttatcaagaaagagccagccaggcggagagggagatgcaagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcagagggcctgaaggtgcaggagaacgaggacaaccttgctctcatccacgccgcccgcgacacactcaagctcatccggaacaagttcctgccggctgtgtgctcgtggatccagcgcttcacccgcgtcgggacccacggtggatgtttaaagcgtgccattgacctgaaggctgaattggagctcgtactgagaaaatacaaggagctggacatcgagcctgagggaggggaaaggcgcaggacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgtt

SEQ ID NO: 198540 - DNA, 1668 bp, Homo sapiens
  Payload ID: 19184
  Gene Name: UV-stimulated scaffold protein A
  Uniprot ID: Q2YD98
  ENST ID: ENST00000512728
  CDS Start-End: 433-1215
gtggcctttccaagcggctgccacctcaggcttgggtgctggggagggctccaggctgcctacatctcaccaccggagcctgagctgccggggctatgggcacagggtgccgggcagtctgggctctcgctgctgcccagcttctttccagcctggcgaatccatctgctcaggctggcacttctgcaaagcccggcagcacagtgtgtgaacagcgtggccacaaggcgggactgccggaccccccgacgcacgccatgttctggcagagcgtggcctgagctgctgctccgggcctcaccctcgcccgtgaggagcagatagcaggcacccacctcgggactgttggaagatggaacacgctaacgcatagggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagaccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgttca

SEQ ID NO: 198541 - DNA, 3099 bp, Homo sapiens
  Payload ID: 19185
  Gene Name: Vac14 homolog (S. cerevisiae)
  Uniprot ID: Q08AM6
  ENST ID: ENST00000261776
  CDS Start-End: 262-2610
tgtgactcgagtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaa

SEQ ID NO: 198542 - DNA, 2161 bp, Homo sapiens
  Payload ID: 19185
  Gene Name: Vac14 homolog (S. cerevisiae)
  Uniprot ID: Q08AM6
  ENST ID: ENST00000536184
  CDS Start-End: 1031-1675
gaacggcctgcctactgtttgcgctttgtggtctggcctctttgttaccaaatgctctggggttgctttggggctgggggtggggaggaatcttctccagcctggccccagagccatggctggcgttcaggggcatttgggaagctgggcccaggtcatgcggagcggaggctgagtccagcgacctaggaggagatggaggtgtttcaggcctcccaccaagaaatgtggctcacgtcactgagcacccaagacctcggggcctccgacgccgtgttggaactgtggtgatgcttccctggagacgggatgcggcgtcaggcactggagcttagccccagacggaaggtggtgtgggcaggggtgccacgctgccgccagcccagcactcaggaagcgcagtgctgcacaccaccctctcaccagccaccccgctcatgccccatcctgcctgcatcatgctgttttggggaagctcccgaatccctgggactccagctgggaagcattgcccaggtgcccttcccctgcaggccaggcctccaagggcacgtggaaaagcagcgcggattcctccaagcctgtcctcaccacccacttctcactgctcgtgtcatccggcccagggaccctgaggaatctgcttttcttcatcctctgggttccctttttgccttttgtataacagggaggctcctcttcacaaagtccgatccttagccctgaacgactcttaactagacaagagatgggaaaggggtcatggcccagggaccagcgagccctaagtgactctggccgtaagtgactctgcgaccttagtcaagtcacttcaccagagtttcaccatccgtacagtgaagaaaaaactcagggtcataacgctgatcccacacggatctgtgctccaggccgcagggtacagcccgaacagtgcaaatccctgacctcgggggcttccaggaggaggagtggggcagtaaacaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccct

SEQ ID NO: 198543 - DNA, 2945 bp, Homo sapiens
  Payload ID: 19185
  Gene Name: Vac14 homolog (S. cerevisiae)
  ENST ID: ENST00000568548
  CDS Start-End: 261-383
gtgactcgagtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctc

SEQ ID NO: 198544 - DNA, 780 bp, Homo sapiens
  Payload ID: 19185
  Gene Name: Vac14 homolog (S. cerevisiae)
  ENST ID: ENST00000566416
  CDS Start-End: 1-780
ggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctgaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctag

SEQ ID NO: 198545 - DNA, 2151 bp, Homo sapiens
  Payload ID: 19185
  Gene Name: Vac14 homolog (S. cerevisiae)
  ENST ID: ENST00000568886
  CDS Start-End: 83-688
gcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggtatttttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaa

SEQ ID NO: 198546 - DNA, 702 bp, Homo sapiens
  Payload ID: 19185
  Gene Name: Vac14 homolog (S. cerevisiae)
  ENST ID: ENST00000567648
  CDS Start-End: 1-52
cgcagaggtggacaagctggtgcagctgattgagtgccccatcttcacatagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaa

SEQ ID NO: 198547 - DNA, 554 bp, Homo sapiens
  Payload ID: 19185
  Gene Name: Vac14 homolog (S. cerevisiae)
  ENST ID: ENST00000563662
  CDS Start-End: 1-554
ctcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggtcagccttggcggcgcgctttctcctcttcctcccacggccccggcttttcactttcacgccattcaagtgtcaaagcagccaccttctctttcccttctctctcctccttttcctgacctttggatctgtaagaaatgaagaaggttgccccttcatactggttgctgatgcttctgacatgaaa

SEQ ID NO: 198548 - DNA, 1745 bp, Homo sapiens
  Payload ID: 19186
  Gene Name: vaccinia related kinase 1
  Uniprot ID: Q99986
  ENST ID: ENST00000216639
  CDS Start-End: 150-1340
cccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggcgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacacagt

SEQ ID NO: 198549 - DNA, 1029 bp, Homo sapiens
  Payload ID: 19186
  Gene Name: vaccinia related kinase 1
  ENST ID: ENST00000557222
  CDS Start-End: 1-697
aaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggcgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaaggtgggcctcatgagagatgtggagtcctcatcacggggttgcctggtgattatggaataagcagcggacttacagacactcagcgtccaggcgcaccaggccaccacatcccagacatgagtacctgtgcaaaatgcattcattcctccatcttggacgagtttactgagcacctgtgatgtgccaggcactaggggtgctgcagcggaagagctaagcattgagggtttgtttgtttgttttttgttttttgagacagagtttcgctcttgttgcccaggctggagtgcaatggcgcgatctcggctcactgcaaccgctgcctcccaggtacaagcgattctcctgtctcagcctcctaagcagctcgaattaacaggcatgcgccacca

SEQ ID NO: 198550 - DNA, 247 bp, Homo sapiens
  Payload ID: 19186
  Gene Name: vaccinia related kinase 1
  ENST ID: ENST00000553683
  CDS Start-End: 1-196
gaagcgaaagaaagaaattgaagaaagcaaggaacctggtgttgaagatacggaatggtcaaacacacagacagaggaggccatacagacccgaagtgaggagtcccaaggagcaatacatcgaagcatgtctcagccagaggctagcagcagcagctatgacagttcaagaaccagaaagagagtccagaagtaattcagatgctgtgaaccagatttccttttctttgttttcttttgacttttt

SEQ ID NO: 198551 - DNA, 599 bp, Homo sapiens
  Payload ID: 19186
  Gene Name: vaccinia related kinase 1
  ENST ID: ENST00000557352
  CDS Start-End: 1-529
atgtcacgatggcactattgaattcacgagcatcgatgcacacaatggcgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaaggtgaattttgttattaaattattctttggtcttcttgtgtttataattgcaataaatactaaaagaaagtatagcagtagttcaatgaagaacaataacagattgcatggcaattaaggcaaacattttttgtaatacagaaaatgtgtagagggttgtagaaaaataaatatttatatatttctta

SEQ ID NO: 198552 - DNA, 1888 bp, Homo sapiens
  Payload ID: 19187
  Gene Name: vaccinia related kinase 2
  Uniprot ID: Q86Y07
  ENST ID: ENST00000340157
  CDS Start-End: 184-1710
gggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaa

SEQ ID NO: 198553 - DNA, 1676 bp, Homo sapiens
  Payload ID: 19187
  Gene Name: vaccinia related kinase 2
  Uniprot ID: Q86Y07
  ENST ID: ENST00000440705
  CDS Start-End: 128-1585
gcagctggagagaagttaggcaggtcctagggagggcaggctcgagtgctgggcccgcctccccgcgggactgtaggcccgggggctccgcctcgtcgcagcggcagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagaca

SEQ ID NO: 198554 - DNA, 1870 bp, Homo sapiens
  Payload ID: 19187
  Gene Name: vaccinia related kinase 2
  ENST ID: ENST00000432057
  CDS Start-End: 116-295
gacgcagctggagagaagttaggcaggtcctagggagggcaggctcgagtgctgggcccgcctccccgcgggactgtaggcccgggggctccgcctcgtcgcagcggcagaagtgatgccaccaaaaagaaatgaaaaatacaaacttcctattccatttccagaaggcaaggttctggatgatatggaaggcaatcagtgggtactgggcaagaagattggctctggaggatttggattgatatatttagagacactggccatttttctctctccaatgcttagtgtggagtaaaggcagcttcccgcaaatttatttcaagcaagagcaatcggaagcttcgacatgtgtgaaagaggcgcatagagaacatagcttccatttcagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagaca

SEQ ID NO: 198555 - DNA, 2381 bp, Homo sapiens
  Payload ID: 19187
  Gene Name: vaccinia related kinase 2
  Uniprot ID: Q86Y07
  ENST ID: ENST00000417641
  CDS Start-End: 628-1818
ggctattcacacgcttcagttcacaacttccatccagaatcctacttctctgattgtcctcatggggaaagtatgctatttccttcatcctacaagatgcttctcactgactctatccatattcttctcatccttcaagagccaagtcaaatctctctgcttccaataagccttccttgctacactcagaaatggaatgaatccccaagatggcttaaggatgcccttctgttttggaatgctttctcttggtgtatatcaaggttggttcagtttaccagagaaaagatgccagtgtcataaagaagaatatttgaagctctataaatatgttgctttacgtggcaaaaaggactttacagatctgagtacactggattatctgggtgggcacaatgtaatcacaaggggctttctaagaaggaagaaggagggttcaaggcagaaaaaccggaagaagttataacattggctttgaagatggaagatggggacacaagtcaaggaattcaggtggcctctagaagcctgaaaagtcaaagaaatgaattctcccctagagcctcaagaaggaacacagccctgctgacagcttgattttaggatttctgacctccagactaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcagtttaggtagaagcttaggctattgatttgaacccactattttttctaatgaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaa

SEQ ID NO: 198556 - DNA, 1916 bp, Homo sapiens
  Payload ID: 19187
  Gene Name: vaccinia related kinase 2
  Uniprot ID: Q86Y07
  ENST ID: ENST00000412104
  CDS Start-End: 517-1689
gtggacaggccgctgaaaggaaccggctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtgtcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaatagtgtcatagaatagtgtcatagtacagtttggaaaacacttctgaag

SEQ ID NO: 198557 - DNA, 553 bp, Homo sapiens
  Payload ID: 19187
  Gene Name: vaccinia related kinase 2
  ENST ID: ENST00000428021
  CDS Start-End: 306-553
ctcttgctctggggtcttgggtggcgggcggcacctccgcttgcagtgccggagccgcggccccgctcggaaaagggctgccgtcggagttagatgccggggactccgggccgtcccagcccccgggcctcagctccggcccgggcagagtcgctgcttccgcgtttggttcttttttccccgctgggagtgagaacaaggcgtccccttctactcacgtttgccaaaagcgggtccgacgtgttagcggaaaagtgtgtcctgcactgttaatatgtgctatagaaccccgaaatgaattttggatgaaatttgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatca

SEQ ID NO: 198558 - DNA, 2446 bp, Homo sapiens
  Payload ID: 19187
  Gene Name: vaccinia related kinase 2
  Uniprot ID: Q86Y07
  ENST ID: ENST00000435505
  CDS Start-End: 746-2272
ggctattcacacgcttcagttcacaacttccatccagaatcctacttctctgattgtcctcatggggaaagtatgctatttccttcatcctacaagatgcttctcactgactctatccatattcttctcatccttcaagagccaagtcaaatctctctgcttccaataagccttccttgctacactcagaaatggaatgaatccccaagatggcttaaggatgcccttctgttttggaatgctttctcttggtgtatatcaaggttggttcagtttaccagagaaaagatgccagggtctcattctgtcacccaagctggagtccagtgacatggtcacagctcactgaagcctcaacctccttggctcaagcaatcctttcacctcagccttctaagtagctaggagcacagtgtcataaagaagaatatttgaagctctataaatatgttgctttacgtggcaaaaaggactttacagatctgagtacactggattatctgggtgggcacaatgtaatcacaaggggctttctaagaaggaagaaggagggttcaaggcagaaaaaccggaagaagttataacattggctttgaagatggaagatggggacacaagtcaaggaattcaggtggcctctagaagcctgaaaagtcaaagaaatgaattctcccctagagcctcaagaaggaacacagccctgctgacagcttgattttaggatttctgacctccagactaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtacta

SEQ ID NO: 198559 - DNA, 1938 bp, Homo sapiens
  Payload ID: 19188
  Gene Name: vaccinia related kinase 3
  Uniprot ID: Q8IV63
  ENST ID: ENST00000316763
  CDS Start-End: 185-1609
gctctccgcccagcggaagttttcgctgggcaactgagaaggtgagtccgggtaactgcggaggatccgagggtcaggctgcagaagcccagaatcccaccccagtccccaagtacagaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccagag

SEQ ID NO: 198560 - DNA, 1749 bp, Homo sapiens
  Payload ID: 19188
  Gene Name: vaccinia related kinase 3
  Uniprot ID: Q8IV63
  ENST ID: ENST00000377011
  CDS Start-End: 171-1445
ggaagttttcgctgggcaactgagaaggtgagtccgggtaactgcggaggatccgagggtcaggctgcagaagcccagaatcccaccccagtccccaagtacagaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgct

SEQ ID NO: 198561 - DNA, 822 bp, Homo sapiens
  Payload ID: 19188
  Gene Name: vaccinia related kinase 3
  ENST ID: ENST00000600137
  CDS Start-End: 290-822
agagcggctccgggtcgcggggttcactggcctcctcttgagcttcccaagccaccttgggctccgtgttgggcatggctaaggcggagatgggcggaacttgtgggaagttcgacagctcctccgctgtgaaacttggcgtctaagtcatcccgtggtttctatggaggtgcggccgaagggaggctctgtcgtcgcctaggcaatcgccccacctgcgctgaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactgtcaacaagtggaagaagctgtactcgaccccactgctggccatccctacctgcatgggtttcggtgttcac

SEQ ID NO: 198562 - DNA, 840 bp, Homo sapiens
  Payload ID: 19188
  Gene Name: vaccinia related kinase 3
  ENST ID: ENST00000596445
  CDS Start-End: 334-840
cttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaag

SEQ ID NO: 198563 - DNA, 1448 bp, Homo sapiens
  Payload ID: 19188
  Gene Name: vaccinia related kinase 3
  ENST ID: ENST00000594090
  CDS Start-End: 89-307
agttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaagccagcctggactcccctgcttggaggagatatatgtgcagcctgccagcttggcacctgcaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtgagtctaggggtcagcagaacccctgcaggtggtcagcagaacccctgcaggtggacagaagcccagagcccaactggg

SEQ ID NO: 198564 - DNA, 572 bp, Homo sapiens
  Payload ID: 19188
  Gene Name: vaccinia related kinase 3
  ENST ID: ENST00000600259
  CDS Start-End: 122-572
aggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaag

SEQ ID NO: 198565 - DNA, 1979 bp, Homo sapiens
  Payload ID: 19188
  Gene Name: vaccinia related kinase 3
  ENST ID: ENST00000593919
  CDS Start-End: 92-1312
ggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtgagtctaggggtcagcagaacccctgcaggtggtcagcagaacccctgcaggtggacagaagcccagagcccaactgggagcaggagggaaggggaggtggcatccagcagagcccaagtcctctgagccgcacaggcatgtgctgcagtgtccacacagcaggcgaggcaggtgttccggagccacactgcctgggctcagactctggcaccaccactgtggggtgttaacgtctgcgagcctcagtgtcctgctccatgagatggtctcctactagctactaccttatgggactgcaaagagttcagggaagtcaggtgcacacagcacttagcacaggggctggctcagagaaaatgctcattgtggccgggcgcggtggctcacgcctgtaatcccagcactttgggaggcagaggcgggcggatcacgaggtcaggagatcgagaccatcctgactaacacagtgaaaccccgtctctactaaaaatacaaaaaattagccaggcatggtggcgggcgcctgtagtcccagctacttgggaggctgaggcaggagaatggcgtgaacctgggagtgggagcttgcagtgagccaagattgcaccactgcactccagcctgggcgacagagcgagactccgtctcaaaaaaaaaaaaaaaaaaaa

SEQ ID NO: 198566 - DNA, 983 bp, Homo sapiens
  Payload ID: 19188
  Gene Name: vaccinia related kinase 3
  ENST ID: ENST00000596121
  CDS Start-End: 67-810
aggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttca

SEQ ID NO: 198567 - DNA, 2126 bp, Homo sapiens
  Payload ID: 19188
  Gene Name: vaccinia related kinase 3
  Uniprot ID: Q8IV63
  ENST ID: ENST00000599538
  CDS Start-End: 666-2090
gtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaaca

SEQ ID NO: 198568 - DNA, 1777 bp, Homo sapiens
  Payload ID: 19188
  Gene Name: vaccinia related kinase 3
  Uniprot ID: Q8IV63
  ENST ID: ENST00000601341
  CDS Start-End: 122-1396
aggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccaggtgggaagagcttgtgaggcttaagcctctcaccccttgccctcacccgagccctgccccaggctccaggagacacttcccagaggctgttccacgttcataccagggcccagcttcccagggagacactgggtttttccgcacggtccttgaacttcccagcctcaaggaatggcaagtagcagaaacccggctcaacttggctttaagaaaagtggggattgattggctgttgtagctagaaaattacaagggggagcttcaggcacaacgggattcagggcctcaaaaatagcatcaagacgttgtttgtctctcgccatcttctgtcccttcttgcatccatgcctccctctgtccttccacccgg

SEQ ID NO: 198569 - DNA, 552 bp, Homo sapiens
  Payload ID: 19188
  Gene Name: vaccinia related kinase 3
  ENST ID: ENST00000601324
  CDS Start-End: 215-552
ggaagttttcgctgggcaactgagaaggtcgctgtcaagatggagtttccaacccagtaaatccaagggccagaccgtgacctcataaaggtattatcccttgggcacagcctctcaagacctttttcctttttcccaccagcagctggctcctgcttgtctcctctgggttgctgctggccagctttactcccagaaggaacgttgtcatagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccag

SEQ ID NO: 198570 - DNA, 836 bp, Homo sapiens
  Payload ID: 19188
  Gene Name: vaccinia related kinase 3
  ENST ID: ENST00000597215
  CDS Start-End: 290-836
agagcggctccgggtcgcggggttcactggcctcctcttgagcttcccaagccaccttgggctccgtgttgggcatggctaaggcggagatgggcggaacttgtgggaagttcgacagctcctccgctgtgaaacttggcgtctaagtcatcccgtggtttctatggaggtgcggccgaagggaggctctgtcgtcgcctaggcaatcgccccacctgcgctgaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaag

SEQ ID NO: 198571 - DNA, 1668 bp, Homo sapiens
  Payload ID: 19188
  Gene Name: vaccinia related kinase 3
  ENST ID: ENST00000601912
  CDS Start-End: 67-1155
aggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagttgccttgggattcattttaatgtaagctggactttgtcatgccagaaacaaggctcggtcaccgtcagcagtttgcagttttccacctcctcccagttcctccgtgtggttgacccagatatctccgttatgcagccgcctccgggggaccacctccctccctttgagtcagccacagacagcctacttgacggccccgctggcccccacattccactgaactgtgcggatgccacagtgaccccctctcaggcacagcatgacctcctgaagtcgagcctgcttgctttgaacctaccagttaaaatctcctcaaaatgtttggataccgcccattggcccctcacagccacgagctccctgaccagtgtgcgtgtgtgtgtgtgtgtgtgtctgtgtgtgtgcttgggacgggtggggaggtcacctttgggtgtgcggtgtgcccccaggacctgtaagtaataaaatctttatttccatcttggatctttcctcatcatcaaagggatcctctccgtcttaaggatcac

SEQ ID NO: 198572 - DNA, 795 bp, Homo sapiens
  Payload ID: 19188
  Gene Name: vaccinia related kinase 3
  ENST ID: ENST00000599342
  CDS Start-End: 65-283
gtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaagccagcctggactcccctgcttggaggagatatatgtgcagcctgccagcttggcacctgcaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggttcttggtgttacccagcctggggaggagccttcagtcggccctggatgtcagccc

SEQ ID NO: 198573 - DNA, 1736 bp, Homo sapiens
  Payload ID: 19188
  Gene Name: vaccinia related kinase 3
  ENST ID: ENST00000596814
  CDS Start-End: 89-682
agttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccaggtgggaagagcttgtgaggcttaagcctctcaccccttgccctcacccgagccctgccccaggctccaggagacacttcccagaggctgttccacgttcataccagggcccagcttcccagggagacactgggtttttccgcacggtccttgaacttcccagcctcaaggaatggcaagtagcagaaacccggctcaacttggctttaagaaaagtggggattgattggctgttgtagctagaaaattacaagggggagcttcaggcacaacgggattcagggcctcaaaaatagcatcaagacgttgtttgtctctcgccatcttctgtcccttcttgcatccatgcctccctctgtccttccacccggccacctgtagtctctactttcctttggcctggcccccttggcgcccccatacacaaaaggtagctgctccatgccttcgggtctcgttcatagtgcgcactaccccttcctgtggatgacggacactcctcacagccagcagct

SEQ ID NO: 198574 - DNA, 1831 bp, Homo sapiens
  Payload ID: 19188
  Gene Name: vaccinia related kinase 3
  Uniprot ID: Q8IV63
  ENST ID: ENST00000594092
  CDS Start-End: 126-1364
ggaggatccgagggtcaggctgcagaagcccagaatcccaccccagtccccaagtacagaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagttgccttgggattcattttaatgtaagctggactttgtcatgccagaaacaaggctcggtcaccgtcagcagtttgcagttttccacctcctcccagttcctccgtgtggttgacccagatatctccgttatgcagccgcctccgggggaccacctccctccctttgagtcagccacagacagcctacttgacggccccgctggcccccacattccactgaactgtgcggatgccacagtgaccccctctcaggcacagcatgacctcctgaagtcgagcctgcttgctttgaacctaccagttaaaatctcctcaaaatgtttggataccgcccattggcccctcacagccacgagctccctgaccagtgtgcgtgtgtgtgtgtgtgtgtgtctgtgtgtgtgcttgggacgggtggggaggtcacctttgggtgtgcggtgtgcccccaggacctgtaagtaataaaatctttatttccatcttg

SEQ ID NO: 198575 - DNA, 1847 bp, Homo sapiens
  Payload ID: 19188
  Gene Name: vaccinia related kinase 3
  Uniprot ID: Q8IV63
  ENST ID: ENST00000594948
  CDS Start-End: 89-1513
agttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccaggtgggaagagcttgtgaggcttaagcctctcaccccttgccctcacccgagccctgccccaggctccaggagacacttcccagaggctgttccacgttcataccagggcccagcttcccagggagacactgggtttttccgcacggtccttgaacttcccagcctcaaggaatggcaagtagcagaaacccggctcaacttggctttaagaaaagtggggattgattggctgttgtagctagaaaattacaagggggagcttcaggcacaacgggattcagggcctcaaaaatagcatcaagacgttgtttgtctctcgccat

SEQ ID NO: 198576 - DNA, 551 bp, Homo sapiens
  Payload ID: 19188
  Gene Name: vaccinia related kinase 3
  ENST ID: ENST00000593912
  CDS Start-End: 1-354
ggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaaatgtatttgtaccctcaaaatcgcatgctggccgtggtgctgtgtgtgatttgcgtaagtgatgttccactctgcgtctcatctgtctctggctctcttcagctttaaccctatccctacatgtggaccgagttcactgcttctgactccggcttctaaatcaattttctatagacatgtctgtgtccttaaactatatatggtggtactgtgtgttaatttgtataaatggcactatgctctaaa

SEQ ID NO: 198577 - DNA, 2739 bp, Homo sapiens
  Payload ID: 19189
  Gene Name: vacuolar protein sorting 11 homolog (S. cerevisiae)
  Uniprot ID: Q9H270
  ENST ID: ENST00000620429
  CDS Start-End: 1206-2660
tatcttgtttgactgtccatgaaaatctcaactttatggccattggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtcaaagagaagcttcacgcagaggccatttccctgctgaagagtggtcgcttctgcgacgtctttgacaaggccctggtcctgtgccagatgcacgacttccaggatggtgtcctttacctttatgagcaggggaagctgttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccgcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatg

SEQ ID NO: 198578 - DNA, 3313 bp, Homo sapiens
  Payload ID: 19189
  Gene Name: vacuolar protein sorting 11 homolog (S. cerevisiae)
  ENST ID: ENST00000621676
  CDS Start-End: 133-2958
tcccagcagcgggacgctgtcaccccgactcaggagctcctgggcccgcgggctcccggaagctgccgaccacgtgattcgctggctcagctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatggaaggccagatctggttcttgccacgttccctacagcttacaggcttccaagcctacaaactacgggtgacacacctgtaccaactgaagcagcacaatattctggcatctgttggagaagatgaagagggcatcaaccccttggttaagatctggaacctggagaagagagatggtggcaatccactctgcactcgaatcttccctgctattccaggaacagagccaactgttgtatcttgtttgactgtccatgaaaatctcaactttatggccattggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtcaaagagaagcttcacgcagaggccatttccctgctgaagagtggtcgcttctgcgacgtctttgacaaggccctggtcctgtgccagatgcacgacttccaggatggtgtcctttacctttatgagcaggggaagctgttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggagcttaa

SEQ ID NO: 198579 - DNA, 3388 bp, Homo sapiens
  Payload ID: 19189
  Gene Name: vacuolar protein sorting 11 homolog (S. cerevisiae)
  ENST ID: ENST00000614944
  CDS Start-End: 249-3044
aaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatccttcgtttggagctgtcttttccctcccgggatcccgaagagatcgagttaggatgaaatctgtttgtcggaggggtccgtgccgcgcgcctctttggtttagctggtcatccagagttgttctgtggtctacgggaagaaagaaggaagtccatctcctaacttgttatcaactgagcaatcctgggaggctccttgactaccctgcacatatggaaggccagatctggttcttgccacgttccctacagcttacaggcttccaagcctacaaactacgggtgacacacctgtaccaactgaagcagcacaatattctggcatctgttggagaagatgaagagggcatcaaccccttggttaagatctggaacctggagaagagagatggtggcaatccactctgcactcgaatcttccctgctattccaggaacagagccaactgttgtatcttgtttgactgtccatgaaaatctcaactttatggccattggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtcaaagagaagcttcacgcagaggccatttccctgctgaagagtggtcgcttctgcgacgtctttgacaaggccctggtcctgtgccagatgcacgacttccaggatggtgtcctttacctttatgagcaggggaagctgttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatt

SEQ ID NO: 198580 - DNA, 542 bp, Homo sapiens
  Payload ID: 19189
  Gene Name: vacuolar protein sorting 11 homolog (S. cerevisiae)
  ENST ID: ENST00000530809
  CDS Start-End: 1-542
ttgagatggcgattaaccttgccaagagccagcatctggacagtgatgggctggcccagattttcatgcagtatggagaccatctctacagcaagggcaaccacgatggggctgtccagcaatatatccgatctgcaagtgattcctgtgtacatgagctggagaagtacactgattcagatgctatcgggtgcacatgtctccctagaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaag

SEQ ID NO: 198581 - DNA, 9967 bp, Homo sapiens
  Payload ID: 19190
  Gene Name: vacuolar protein sorting 13 homolog A (S. cerevisiae)
  Uniprot ID: Q96RL7
  ENST ID: ENST00000357409
  CDS Start-End: 172-9459
gcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatctaaa

SEQ ID NO: 198582 - DNA, 15320 bp, Homo sapiens
  Payload ID: 19190
  Gene Name: vacuolar protein sorting 13 homolog A (S. cerevisiae)
  Uniprot ID: Q96RL7
  ENST ID: ENST00000360280
  CDS Start-End: 261-9785
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatcaaaccacaagtttaaaatcacatgaaagtgtgtttccatgttgacctttgtttaaaaaaaaaaaaaagtgcttattttctctgtcgctaagctcctccagttttgcttttgtcagaattaaacttaacagtagaggtagtcagaaagcttgcatcagactgtcctcatccaaaacgaaatacttcattacccaatgttatgatttcaccattctcagaaaaattacagtcccctgcctccctgggtgtagtgtcgtgaagtagaaaagccttacataaatagtaaacatagaaattcttctggtgccctctggcagccagcaggagtgggtcttgtgactaatccacatggaaaggatagtgcctgtctttcctgttcccttgccataagaaccgtgaaatctctcctttccctgccactcgtttactcatcacctcctcccatcacttccttgtctctagactagagggacccacagttttaagagctacatcatatcatttgttgttttagaagattgtcttcatctaaacaaaaacactaagaaatcagtagatcactagataatgagtcagtgtttttagcatcacattttacaatttacagtttttgtttgattctgtagcccatttttcttgaaggttagaataagaatcttcttgtatttgaaaaccatctgccctaaattacatttaactacaagaaatggctctctgctggagaaatttaagcttgtcttagttgtttggtagtggctatggaatgagaggtgttgagtcttgtgccccttccatgtattatttgctaactaactatattactaggcccttaattccagcacagcatgtcttctggtctatgataattgtgtgaggactaaggcagagtgcctgttccctgccaactctccaccagaaaatcataatcagaaagagtgactttgatttctggtacttgtgatcaaaagcagcttgtgatttcttcacatttgcaaaatactctctgagccaaaaggcacatacagttctccagtgtcttcccttttagagtatacatatttgctgcttttcctttagtgttcacaaaaatcccaaggtcagtttagtgtggctgagttgttgttatctggaccctaaacaatcattaccacctgtagacagttcttacctacccctctcctccacaatcctagtccatttggaggcaactatcctgtggcctccaagtgaataaatctttcttacacttacttacgtgatattttctatcataattatctctctcatttcttccaatagtaatagcggtaatattgttccattgaatatctatgcacctagctcatctcttagaaacatcccacatagtagcatcgtattactctctggtaaaaagaaagattaaattaaaaggactctacacagtgctgaatttcctgcacctaaattattcagttatcacttgccagtattagttgatccttcaggctatgccaagtgccccctcatgtaggcctctgtattaaaaagattgggacaaaatacttgattagtttgcctgtagaagctcaaagtgtgtaccaaatacattgacagtggatgctttcatggctcagccaacacagttcagaggaatcttttcggcttccagggcattgcttgttaccttttgtcaggatcaacccaaatcctcagggatgctgtttttccacactgtaagtcctaactcattagtgggtcatgaaatcaacttaacagctcaagaccagtatattttaaacgtgaaataataaaaaatagaggaacaatagagcatataaaatggttaagtattggttcctgaaatactgtttcagctaaatattctatttactgtgtatactgggtcacaatataaagtgtttcctgttatgaaatgcaatttaaaaaaagaaagcttgaaagactgctgcaggaggcaccggccatccagtgattgttggaagagtctggattgtgtggagcctgaccttagataaggagcagcagatccacaactcaggaagtctagagatgcttagcacttcttcttttgagtgagaagatggaatcactcttggtttctaaaatatttttcttctctgctgtgtatcgggcaacctcacatgattcagtgggaccagaaaaagcatagaaaaattagatccacacacagcacccaaaaaaggccatagtcttttgtttacctagatgtattttaacctctttaccactaagcattttactataatagaactggggacatacattgtccttttgagtccgttgaatctgcaccatctaccttttggctgattcaccatacaggtggcaaaggcctttaaaaatggggagctaatacgtagggcacattctggtagggccaaaatattcagtgtctggggggtgctatgcaaatatcaatgactttttactaaaaacagtggatttcctcatttctttaagatccaagtagaaaatgtaaataacttacattctgtatgcaggactcaatacagacttagtcaatctgattttttttggtgcttttcagtatagcgcaactctaaaaggaaacccattcaccctccttagtcctttgaagtatacttttgaaattataccttattgttaatggcaacctaatcaagctaggatttgtcggttaaaattttgattcttgtaatctgtactgtcaatttttggccactctggctgttacagcaaacttttctcccactgtcataattggtctaaagtagtatttgtttcaggactatccaaaaagcaaggccagcacattgagaagatgcagaatcctactctattacaaacctcactcatgtttcttttattgaaacctttttctactttatatttcctcttttgtaaatttttccatgtcatttaaaaaattttttactttagaattacagattagttctttttttaaagcattatggcattttcaaaaaaaaaattattttggttacccaaaaagctatacaagaaatataacttcaattttttaggttgatatgggtatatttttaaagtttttattactttatacaaatacaaattaatttatattatagtttaacacctgctatgatgatagatatcacactgctatgatagaaaatccctgtctgtcattgaactattcatttagtgttactctgatatgttaataatgtattccttctaatgaagtccttgtaacaagaaaccctgtgagattggtataatgagatatcaaataatcagaagtataattaaaatagaacatgttggaaaatcccaacatttcctgttatgccgtcatacctccggtgttcagtttgttactcaaaagttcccagttcttaggctgaaaaacattcaagtaaaaatgtagcatagattacactgaaatattttcagtatcaatgatttaatatccacacaaactattaggaatggtatctggaacttgttacaaggtcagataaactgttacagaattttagaaataattatctctgtatgtgactgtgtattacatataaaaatgaatttttcaggaaaagtgcactttaaaaatactttctcttgctagttttttaaattgatgaaatagcctgtgctgctttggaatgcttattctttctttgatgaaaatacggtcattgattatgataattttaaaaatatctatttctgcatcgctgcaggatttcctacacttttctgttcctcatccctcttttatgtgtgcttggctcagttgcctgttacacagcctctgccttggttttgtgtattctaagataatttataaacacagatatttacagtgaagttcttccttttgaaactaatcttattcttttattcctctctctaaaaattggttggccatgctcactaatgattttttttcttaacaataagcatttcttggtattggtagatttggattgcatggtaagatgactgcccattttcaccatgtatacctttgtcaaataaagatttctgatctttggtc

SEQ ID NO: 198583 - DNA, 10269 bp, Homo sapiens
  Payload ID: 19190
  Gene Name: vacuolar protein sorting 13 homolog A (S. cerevisiae)
  Uniprot ID: Q96RL7
  ENST ID: ENST00000376634
  CDS Start-End: 353-9562
aggcgatggggaggaggcggggccgacaggaaagaggagccgggctcggcgcgaaaagggcaccctccagagccgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaactagtaatcatatataggctataccagtgtcatgttgtttctgtggtttagaggtggaatactaaattaaatcatttgtttgaaaacaaa

SEQ ID NO: 198584 - DNA, 11145 bp, Homo sapiens
  Payload ID: 19190
  Gene Name: vacuolar protein sorting 13 homolog A (S. cerevisiae)
  Uniprot ID: Q96RL7
  ENST ID: ENST00000376636
  CDS Start-End: 261-9668
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaa

SEQ ID NO: 198585 - DNA, 2262 bp, Homo sapiens
  Payload ID: 19190
  Gene Name: vacuolar protein sorting 13 homolog A (S. cerevisiae)
  ENST ID: ENST00000376646
  CDS Start-End: 311-643
caattggaagataactgccgtcagccgacgtggtctttccctttacttcaggaggagaatgactactaatctggaagaaaggtcttactatagcagtcagatcaccagagtagtgccgaacacttcctggcttcatctgaaaatttgaatgaataccagtttatgcaagttcttagtcatcattatataaattcctcatttttgtcctctttggcaagacaaaatctattctatttaagagtagattttaagaatttaaaagaatagattttaagaatttaaaaaagaatctttttttcctttcaaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatcaaaccacaagtttaaaatcacatgaaagtgtgtttccatgttgacctttgtttaaaaaaaaaaaaaagtgcttattttctctgtcgctaagctcctccagttttgcttttgtcagaattaaacttaacagtaga

SEQ ID NO: 198586 - DNA, 2781 bp, Homo sapiens
  Payload ID: 19190
  Gene Name: vacuolar protein sorting 13 homolog A (S. cerevisiae)
  ENST ID: ENST00000419472
  CDS Start-End: 1-1151
agtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagaggtatcggcaaactgatttagtgccttcctgtttttgattttgtagtttcagttttttaagattaagatcaataaaaactattttaaagatctaataaaaattagaatactagtaaagaataggtaatgcagatattcttttgcaacaagtatgagaattattattgaaataacatttaagaactagacttcagtgacaaaaaagcatgctacattatgttgtattcttttagtgctgattttcttaaaagattgtatactttgtgaagttgctttttttctttcatactctgtgtggtttcttcctgttgttataggaatccatacatcttaagattttatgtaaatatttcatttgcagtgcttatcaaatggaagaaagtagttcttcattgtcatctattataggtttattttacttttagaattaccatttgctttttaaaaaaatttttttgagactaggtttctctctgttgctcagactggagtgcaatgatgcgatcatagctcactgtagtctcaaacttctaggctcaagtgatccttccacctcagccccccgagtagctgggactacaggtgcatgccatgcctggataatattttttaatttttaattttgtagggacagggactcactatggcttgtcttgaactcttgggctcaagtgatcctcccgcttcggcctcccaaagtgctggaattacaggcatgagccagtacacccagccgtttacacttttctgatacatgtctcttttggaggaaaaagttaacatatttatggttttaaatgtgtatttccatattgaataacaaattatcatagtggttaagaatttgtactttgctgtcaggtagatttgaaattgcatcctagctctgtcatttgctagctgtatgttcttaagcaggctttattgcttttctaaatcttttgctgtggtctgtaaaatgagaataataataaaatttgcttggttaagacatgggggaaatcaaattagattgtgtatgtaaaggatttggtacagtgcctcccagacacagggttgccatttatttatcactctagcactaccaccaccattgttattttgtggaatattatttaacttgtaaagaatcaagaactccttacttttgctttaattaatttaaaatcatgagatgaagagattcctatattataataataggaaaagaataggatagagatgctggaaaaactggtgagatattcagatgtactgtcaatttatatttctgttctcatagaacttttaattggatgctgttagtgatcacattctgtctgccagtttccaaagggtgtgatcagtttttagaaagacaattgagccatggtgtggggaagggactagaggggacaagagcggttaggggactcttaaactgagacgtcatatagtgacatgaactaagataatagaagggagggtcgagggaaatgagcagtttggagagatacatatgacgtaataatataaacagtgattggaaatgggtgatgagggattgtggaggtagtagggattacttattttggattaccatcagtttttgcccacattttacgttgttttgtagttttcaaaataaaaatcacgagtggttaaga

SEQ ID NO: 198587 - DNA, 2001 bp, Homo sapiens
  Payload ID: 19190
  Gene Name: vacuolar protein sorting 13 homolog A (S. cerevisiae)
  ENST ID: ENST00000493341
  CDS Start-End: 1-534
ctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtagaatccatacagaatgtcctggtgatgctgccaacaatctgcaagtgcccagctgccttttgaggccaaccctctaggttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatc

SEQ ID NO: 198588 - DNA, 324 bp, Homo sapiens
  Payload ID: 19190
  Gene Name: vacuolar protein sorting 13 homolog A (S. cerevisiae)
  ENST ID: ENST00000467124
  CDS Start-End: 1-125
gattgcgcattgaagcaaaggaacgagtgaagtctgtatttcatgccagagagtttggaaaaataattaacttcaagaccccagaggatgccagggtaaatataataaatcttttatttaaataggagctgctcacttcaaaatcattggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaa

SEQ ID NO: 198589 - DNA, 1155 bp, Homo sapiens
  Payload ID: 19190
  Gene Name: vacuolar protein sorting 13 homolog A (S. cerevisiae)
  ENST ID: ENST00000484581
  CDS Start-End: 436-768
ttaaaatgtgtttgcatgggtatgtgtgtgtatgattcctgtgtccttcattgtgtctgaatgttgacagctgagttgttgtcctgtgggtgtagtatagtgtgttcttaaacatttcaggtatttttgaatttatctatgttgtctttgaatcttttacagggattctataactgccgtcatgtaagttgttacagaagggaggctgtttttgtgtcttgtatatttcttttctttcagaaattacagatgtttataattagcttcaaacactgccttaatagcaattggaagataactgccgtcagccgacgtggtctttccctttacttcaggaggagaatgactactaatctggaagaaaggtcttactatagcagtcagatcaccagagtagtgccgaacacttcctggcttcatctgaaaatttgagtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcaca

SEQ ID NO: 198590 - DNA, 2822 bp, Homo sapiens
  Payload ID: 19191
  Gene Name: vacuolar protein sorting 13 homolog B (yeast)
  Uniprot ID: Q7Z7G8
  ENST ID: ENST00000355155
  CDS Start-End: 112-2703
ggcgcggtacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaactcacagaaatgcaagttgagagtagttattacagtccacagaaagtaaaatctaaagaagtattgtgttgggaacaagaaggaactacagttgaggcccttatgatgggagaacctttctttgattgccagattgggtttgttggttgcagagccatgtgccttaaaggaattatgggtgttaaagattttgaagagaatatgaatagaagtgaaactgaagcctgtttcttcatttgtggtgacaatttgagtacgaaaggtttcacataccttacaaattcattgtttgattaccgaagcccagaaaataatggtactcgcgcagaatttatcttggattcaactcatcataaggagacatacactgagatagctggaatgcaacggtttggggctttttatatggattacctgtatacaatggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcagcactgctctttatgggaaacttctgaaactccccacatgctggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtatagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaa

SEQ ID NO: 198591 - DNA, 14019 bp, Homo sapiens
  Payload ID: 19191
  Gene Name: vacuolar protein sorting 13 homolog B (yeast)
  Uniprot ID: Q7Z7G8
  ENST ID: ENST00000357162
  CDS Start-End: 112-12105
ggcgcggtacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaactcacagaaatgcaagttgagagtagttattacagtccacagaaagtaaaatctaaagaagtattgtgttgggaacaagaaggaactacagttgaggcccttatgatgggagaacctttctttgattgccagattgggtttgttggttgcagagccatgtgccttaaaggaattatgggtgttaaagattttgaagagaatatgaatagaagtgaaactgaagcctgtttcttcatttgtggtgacaatttgagtacgaaaggtttcacataccttacaaattcattgtttgattaccgaagcccagaaaataatggtactcgcgcagaatttatcttggattcaactcatcataaggagacatacactgagatagctggaatgcaacggtttggggctttttatatggattacctgtatacaatggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcagcactgctctttatgggaaacttctgaaactccccacatgctggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtgtgaaatctaagaatcccctgccaactcttgagggctcaatccagaatgttgaattgaagtactgcagcacatcattggtcaaatgtgcctctgggaccatgggatcaataaaaatttgtgccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaatcccgcccattgtcagttcctgttaaagccatgttgaatatatctgaaagctgtagaagtcctgaagaaagaatgaaggaatttattggaattgtttggaatgcagtgaagcatctcacactacagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcaggccaggggaaggttggcagtcaggacattttgaaggagtatttctacaatgcaaagaaaaatctgtgacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttattccaaaaacagaagaaatgcagccaactgttgaagctaatcaggcagcaaaagaagacactgtggttttgaagattggctctgttgccatggctccccaggctgacaatccccttggcagatctgtccttaggaaagatatttaccagagagccttgaacttaggaattcttcgagatcctggatcagaaatcgaagacagacaataccaaatagatctgcagtccatcaatattggtactgcacagtggcatcaactaaaaccagagaaggaaagtgtctcaggaggggtggtaacagagactgaaaggaattctcaaaatccagcccttgagtggaatatggccagcagcatacggcggcatcaagaaaggagagcaattttgacccccgttttgacagatttttctgtccgaataactggagcacctgctgtcattttcaccaaagtagtttctccagaaaatttgcatactgaggagattttagtgtgtggccattccttagaagtgaatataaccacaaacctggacttcttcctaagtgtggctcaagttcaactcttacatcagttaatagtagcaaatatgactggactggaaccatcaaacaaggctgcagagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctcacgccagtcatcaattgtaaaaaatctaaattttattccctttgacatatttattactgcaagtagaatctcactaatgacctattcctgtatggccttatccaaatcgaaatcacaagaacagaagaataatgaaaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtatagatcctgggaagactctgcctgaagcccttgattattgcactgtttggctacagacagtgcctggagaaatagacagcaaaagtggtattccaccttcctttataacactacagattaaagactttctgaatggaccagcggatgtcaatttggatatatcaaagcctttgaaagcaaacctgagtttcaccaaactggatcagataaacctttttttaaagaagataaaaaatgcacacagtttggcacatagtgaagagacttcagccatgtccaacaccatggtgaataaggatgatcttccagtctccaaatattaccgtggaaagttgtctaaacccaaaattcatggtgatggagtgcaaaagatttcagctcaagaaaacatgtggagagctgtttcctgctttcaaaaaatttctgttcaaactactcagattgtgatctccatggaaactgtaccccataccagcaaaccatgcctgttagcatctctctcaaacctcaatggaagccttagtgtcaaggcaacacaaaaagtacctggcataattcttgggtcatcatttctactcagtataaacgattttctccttaaaacaagtctcaaagaaagaagccgcattctgataggaccatgttgtgctactgccaatctggaagctaagtggtgtaaacacagcgggaatccaggcccagaacaatccataccaaaaatatccattgacttaagaggaggtctactacaggtcttctggggtcaagaacatttgaattgtttagttcttctacatgaattactcaatggataccttaatgaggagggaaattttgaagtacaagtttctgaaccagtgcctcaaatgtcatctcctgtggaaaagaatcagacatttaaaagtgaacaaagttcagatgacctacggacaggtctatttcagtatgtacaggatgctgaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaagttatgtcagttctgcatttcctccatggtacagcaaggtatacaaattattcagattgaagacaagactacaataatcaataatacaccatatcaaatattttataaaccacagctatctgtctgcaatccccattctggaaaggagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgacatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaaccaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtattttacatggagctggactttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatta

SEQ ID NO: 198592 - DNA, 14094 bp, Homo sapiens
  Payload ID: 19191
  Gene Name: vacuolar protein sorting 13 homolog B (yeast)
  Uniprot ID: Q7Z7G8
  ENST ID: ENST00000358544
  CDS Start-End: 112-12180
ggcgcggtacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaactcacagaaatgcaagttgagagtagttattacagtccacagaaagtaaaatctaaagaagtattgtgttgggaacaagaaggaactacagttgaggcccttatgatgggagaacctttctttgattgccagattgggtttgttggttgcagagccatgtgccttaaaggaattatgggtgttaaagattttgaagagaatatgaatagaagtgaaactgaagcctgtttcttcatttgtggtgacaatttgagtacgaaaggtttcacataccttacaaattcattgtttgattaccgaagcccagaaaataatggtactcgcgcagaatttatcttggattcaactcatcataaggagacatacactgagatagctggaatgcaacggtttggggctttttatatggattacctgtatacaatggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcagcactgctctttatgggaaacttctgaaactccccacatgctggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtgtgaaatctaagaatcccctgccaactcttgagggctcaatccagaatgttgaattgaagtactgcagcacatcattggtcaaatgtgcctctgggaccatgggatcaataaaaatttgtgccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaatcccgcccattgtcagttcctgttaaagccatgttgaatatatctgaaagctgtagaagtcctgaagaaagaatgaaggaatttattggaattgtttggaatgcagtgaagcatctcacactacagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcagccttggggaagagtgttggtctttggggcaatgtggaggtgtcttcctttcctgtactgacaagctgaacagacgcaccttgttggttcgacccatcagcaagcaggaccctttcagtaattgctctggcttctttccttctacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttattccaaaaacagaagaaatgcagccaactgttgaagctaatcaggcagcaaaagaagacactgtggttttgaagattggctctgttgccatggctccccaggctgacaatccccttggcagatctgtccttaggaaagatatttaccagagagccttgaacttaggaattcttcgagatcctggatcagaaatcgaagacagacaataccaaatagatctgcagtccatcaatattggtactgcacagtggcatcaactaaaaccagagaaggaaagtgtctcaggaggggtggtaacagagactgaaaggaattctcaaaatccagcccttgagtggaatatggccagcagcatacggcggcatcaagaaaggagagcaattttgacccccgttttgacagatttttctgtccgaataactggagcacctgctgtcattttcaccaaagtagtttctccagaaaatttgcatactgaggagattttagtgtgtggccattccttagaagtgaatataaccacaaacctggacttcttcctaagtgtggctcaagttcaactcttacatcagttaatagtagcaaatatgactggactggaaccatcaaacaaggctgcagagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctcacgccagtcatcaattgtaaaaaatctaaattttattccctttgacatatttattactgcaagtagaatctcactaatgacctattcctgtatggccttatccaaatcgaaatcacaagaacagaagaataatgaaaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtatagatcctgggaagactctgcctgaagcccttgattattgcactgtttggctacagacagtgcctggagaaatagacagcaaaagtggtattccaccttcctttataacactacagattaaagactttctgaatggaccagcggatgtcaatttggatatatcaaagcctttgaaagcaaacctgagtttcaccaaactggatcagataaacctttttttaaagaagataaaaaatgcacacagtttggcacatagtgaagagacttcagccatgtccaacaccatggtgaataaggatgatcttccagtctccaaatattaccgtggaaagttgtctaaacccaaaattcatggtgatggagtgcaaaagatttcagctcaagaaaacatgtggagagctgtttcctgctttcaaaaaatttctgttcaaactactcagattgtgatctccatggaaactgtaccccataccagcaaaccatgcctgttagcatctctctcaaacctcaatggaagccttagtgtcaaggcaacacaaaaagtacctggcataattcttgggtcatcatttctactcagtataaacgattttctccttaaaacaagtctcaaagaaagaagccgcattctgataggaccatgttgtgctactgccaatctggaagctaagtggtgtaaacacagcgggaatccaggcccagaacaatccataccaaaaatatccattgacttaagaggaggtctactacaggtcttctggggtcaagaacatttgaattgtttagttcttctacatgaattactcaatggataccttaatgaggagggaaattttgaagtacaagtttctgaaccagtgcctcaaatgtcatctcctgtggaaaagaatcagacatttaaaagtgaacaaagttcagatgacctacggacaggtctatttcagtatgtacaggatgctgaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaagttatgtcagttctgcatttcctccatggtacagcaaggtatacaaattattcagattgaagacaagactacaataatcaataatacaccatatcaaatattttataaaccacagctatctgtctgcaatccccattctggaaaggagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgacatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaaccaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtattttacatggagctggactttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatta

SEQ ID NO: 198593 - DNA, 1626 bp, Homo sapiens
  Payload ID: 19191
  Gene Name: vacuolar protein sorting 13 homolog B (yeast)
  Uniprot ID: Q7Z7G8
  ENST ID: ENST00000441350
  CDS Start-End: 104-1351
acaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaaaaa

SEQ ID NO: 198594 - DNA, 466 bp, Homo sapiens
  Payload ID: 19191
  Gene Name: vacuolar protein sorting 13 homolog B (yeast)
  ENST ID: ENST00000521559
  CDS Start-End: 1-466
ctaatcaggcagcaaaagaagacactgtggttttgaagattggctctgttgccatggctccccaggctgacaatccccttggcagatctgtccttaggaaagatatttaccacatacggcggcatcaagaaaggagagcaattttgacccccgttttgacagatttttctgtccgaataactggagcacctgctgtcattttcaccaaagtagtttctccagaaaatttgcatactgaggagattttagtgtgtggccattccttagaagtgaatataaccacaaacctggacttcttcctaagtgtggctcaagttcaactcttacatcagttaatagtagcaaatatgactggactggaaccatcaaacaaggctgcagagatctctaaacaagaacagaaaaaagtggatatatttgatggaggcatggctgaaacctcatctcgctacagtggtgctcagga

SEQ ID NO: 198595 - DNA, 5625 bp, Homo sapiens
  Payload ID: 19191
  Gene Name: vacuolar protein sorting 13 homolog B (yeast)
  Uniprot ID: Q7Z7G8
  ENST ID: ENST00000496144
  CDS Start-End: 112-4395
ggcgcggtacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaactcacagaaatgcaagttgagagtagttattacagtccacagaaagtaaaatctaaagaagtattgtgttgggaacaagaaggaactacagttgaggcccttatgatgggagaacctttctttgattgccagattgggtttgttggttgcagagccatgtgccttaaaggaattatgggtgttaaagattttgaagagaatatgaatagaagtgaaactgaagcctgtttcttcatttgtggtgacaatttgagtacgaaaggtttcacataccttacaaattcattgtttgattaccgaagcccagaaaataatggtactcgcgcagaatttatcttggattcaactcatcataaggagacatacactgagatagctggaatgcaacggtttggggctttttatatggattacctgtatacaatggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcagcactgctctttatgggaaacttctgaaactccccacatgctggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtgtgaaatctaagaatcccctgccaactcttgagggctcaatccagaatgttgaattgaagtactgcagcacatcattggtcaaatgtgcctctgggaccatgggatcaataaaaatttgtgccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaatcccgcccattgtcagttcctgttaaagccatgttgaatatatctgaaagctgtagaagtcctgaagaaagaatgaaggaatttattggaattgtttggaatgcagtgaagcatctcacactacagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcaggccaggggaaggttggcagtcaggacattttgaaggagtatttctacaatgcaaagaaaaatctgtgccttggggaagagtgttggtctttggggcaatgtggaggtgtcttcctttcctgtactgacaagctgaacagacgcaccttgttggttcgacccatcagcaagcaggaccctttcagtaattgctctggcttctttccttctacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttattccaaaaacagaagaaatgcagccaactgttgaagctaatcaggcagcaaaagaagacactgtggttttgaagattggctctgttgccatggctccccaggctgacaatccccttggcagatctgtccttaggaaagatatttaccagagagccttgaacttaggaattcttcgagatcctggatcagaaatcgaagacagacaataccaaatagatctgcagtccatcaatattggtactgcacagtggcatcaactaaaaccagagaaggaaagtgtctcaggaggggtggtaacagagactgaaaggaattctcaaaatccagcccttgagtggaatatggccagcagcatacggcggcatcaagaaaggagagcaattttgacccccgttttgacagatttttctgtccgaataactggagcacctgctgtcattttcaccaaagtagtttctccagaaaatttgcatactgaggagattttagtgtgtggccattccttagaagtgaatataaccacaaacctggacttcttcctaagtgtggctcaagttcaactcttacatcagttaatagtagcaaatatgactggactggaaccatcaaacaaggctgcagaggtaactgttacctgattttgatcaggcttactgcatttgttccaactttacattcacagtaggaaaactataattaagctgactgctttctgcttaattattctgtgtttaactttattcaaaatatagtcataagtcattttggattgata

SEQ ID NO: 198596 - DNA, 13300 bp, Homo sapiens
  Payload ID: 19192
  Gene Name: vacuolar protein sorting 13 homolog C (S. cerevisiae)
  Uniprot ID: Q709C8
  ENST ID: ENST00000249837
  CDS Start-End: 100-11232
ggcctgcgccggaggggctgtcatttgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtttacaggtgtgaaaa

SEQ ID NO: 198597 - DNA, 13400 bp, Homo sapiens
  Payload ID: 19192
  Gene Name: vacuolar protein sorting 13 homolog C (S. cerevisiae)
  Uniprot ID: Q709C8
  ENST ID: ENST00000261517
  CDS Start-End: 75-11336
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaaggcacacattcaggggagttcatatatggcttggagaactttgtttacaaggacatcaagcctggacgtaaacgtaaaaagcacaaaaaacattttaagaaaccttttaaaggtcttgatcgttcaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtttacaggtgtg

SEQ ID NO: 198598 - DNA, 14579 bp, Homo sapiens
  Payload ID: 19192
  Gene Name: vacuolar protein sorting 13 homolog C (S. cerevisiae)
  Uniprot ID: Q709C8
  ENST ID: ENST00000395896
  CDS Start-End: 75-10961
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaaggcacacattcaggggagttcatatatggcttggagaactttgtttacaaggacatcaagcctggacgtaaacgtaaaaagcacaaaaaacattttaagaaaccttttaaaggtcttgatcgttcaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagcaagaactggaaatacaggaataaatgtttcctaaactactacttgatttcatccttaaaaatcaaaacaaactgtggtgttaattgactgtgtgtgaattccattgtcaattttaatgaaattttctttaaaactctcacctccatctgaacttttcatagtagtgggattgactacaaataaaaacttgtggtattcctggtaatactgtccagaaataagagattagtataaaatattaaaggatgcagagaatcagctctcttctgcgtttaatagatgaaagcctttattgagctcagaagcagatactgttactatcatttcgaaaattttatcttatggtgttcatgtgcatttcaggtaaaattgaaaaacaggacaattattatgtccaattaatatgtttatgtttgtgagtcttgatgatggaattacatagctttctgtttcacaaatggctctaaatttgcttaagttacgggactattacctggagcatctgctttaataattgaattgtcagttgctctgagcctgcccttagacctcaagtaataaatagttggcacatgaattttgaggatatgtttcctcttccctctttttcctatttaaccccttggtactgttgctaaataaatgatagccattttataattatgttatatacattttcagcctttagcatttctgcttttcaaaaattgaatctccttgttggttatgcttatttcataattattagttttaattaatgtagatagaagttgaacatgtaattaggcaaattgctgtgtggcacttgaatacatagatttctttattttcaaaaaccaaccttttgcttttaaatccttagagagggtttattatcttagagaaaaaataattataatcattatttttgaaattagtatcctcttaattctcaacataagttatgtttcaatttcttttttttgtaataaatgatggaaatgtttaacaatgtcttatctagcaactttcatgcttctcctcagaaatgaagccaaagtataaacttagatttaatgtgttgtatatttgaagagaatgaaactattaacatataattgttcagttggattatgtattttaaggattgcagttatcaaaataataaattgaatgttttatgtttaaccactttaaagaagaaagactgacatccaaaaaccagcgtgtgctagatatacaaaggaaattacttctgtccttaagggaccaagtataacaaaacatgtaactgttaaaagtagctgacaaacctttcttgtgcctagataatttagcattggcaaaaatgtcaccacatgcagttttctaggagagtcaagcacaaataactaattcaagatgctgacttaaatcatctccaatagttacccttcctgagattctaaagtaacaatttttaattttactggttatattgctgttttactgagacttacttttaagaacccctgtaacttaagattttttcttaattgttttgtttagctctgttattaattttttccttgtgatatctttttataactctctgtcaaaaagcacaaaacttcaagaaacttttaattattttgtctgaacatataatcttgtctgatttcttagtttttattaagatatcagacaacttttaaaactttagtgcattattataattactggaagaaaaagaatgattatacactaatgagaggacttggtagtttttgtcgtggatgtcaagtgtgggcatggataattgaaatatttaggctatttcattctttgcccatcttgctgtgatcagttagttgggtaaaaatatttattgattatttagactgtactggatatacaaaagaagccttctgtccttaagggaccgagtaaaacaaaacatggaaatattaaagagtattagagtataaaagtatatctttttagccctttgtaatatggccaaattctaaataatttatttggggatcttttgatcctcatgttcctttttctcctaagtactactttgtattctttaatatgcagctttgagagttactgaatcatatattatatttccatgagatgtactattctacttatcctctaatcttcatatatatatacacacacacatatatatacacatacatatatacacacgtacatatatgtacacatacagatatacatacacacaaacacatatatacacacatacatatacacacatatatatacacatacaaatatacacatatatacacatacatatatatacacacatacaaatatacccatatgtacacatacatatatacacatacatatatacacacacatatacacacatatatacgcaaacatacacatatttacacatacatatatacatacattatatgtatgtatatatagtcatttaatactcattttggttcacatacttatgatcatgcaacgtttaaaacagcatttcttgctttttagttttagttatatttttccatgttcttagaaatgcctcattaacatttttaattcttgtattgccatctattgaggtgacattacattgtgtttttatctcgtcttaattcatgacattaaattattctactaacagtaataatgctgtaataaacatcattatagattttgcttttttatatcttgtttgctttttcatatttccttagaatttacttgaaaaaattgaattactgggtaaagggcttttgcaaagtattgttaaattcctcgagttgcatttttggaaaggggacgtgaatattttatcaactaatttggtctccctgctgccattagtgactgaatatcttaatctgaatctcagagtgtagtgggtttttagtagtgctgaagacaagttttctaaagtgtattatggtgataaattatattttaaaaactgtcaatggcttgaagcacaatagcctaataactaacgaaaatacatacaagatagaaagtgggtagtatttcttgtacttgcatttcagatctaaatattttaacatatttaaatttcaagctgcagataaatgcattacattattaaattcatttcccattttctctttgaagaaattaaggcaaaagtgttaaaagattttaactaattcgcacaagtgaattgtgaaacaagtagctattgctgtgaaatctgcactcctctctgagactcattctgaagatgagatcccagttctttgtggattcctcttccttattcatggctttttgcaattgtcaaggaatgactaggtaccaagcaactttaaaaaatgtatatttaagcattgaaataatatcaaatgtgatttctctgcttgtggttatattgattatattatccttttaataatattggcattatattcttggtcgtaaaatgtcaaggtcttatttattcagtatatttatgttctgtattttcatatatattatctattttcagccatgcattatatataatgtcagtaatagtatttcattagcattcattataaaaaaactcgtttttaatatttgactaattcaagtcacagtacttttgagatagctgaaaaggaaaataaatgtgttttaatgtgctacta

SEQ ID NO: 198599 - DNA, 11012 bp, Homo sapiens
  Payload ID: 19192
  Gene Name: vacuolar protein sorting 13 homolog C (S. cerevisiae)
  Uniprot ID: Q709C8
  ENST ID: ENST00000395898
  CDS Start-End: 75-10832
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagcaagaactggaaatacaggaataaatgtttcctaaactactacttgatttcatccttaaaaatcaaaacaaactgtggtgttaattgactgtgtgtgaattccattgtcaattttaatgaaattttctttaaaactctcacctccatctgaacttttcatagtagtgggattgactacaaataaaaacttgtggtattcctggt

SEQ ID NO: 198600 - DNA, 10969 bp, Homo sapiens
  Payload ID: 19193
  Gene Name: vacuolar protein sorting 13 homolog D (S. cerevisiae)
  ENST ID: ENST00000011700
  CDS Start-End: 1-9632
ttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagcctcccccttgtctaccttagaactaggagtacagccagtctgactaacctagagcaccagatctatgctagagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttct

SEQ ID NO: 198601 - DNA, 3838 bp, Homo sapiens
  Payload ID: 19193
  Gene Name: vacuolar protein sorting 13 homolog D (S. cerevisiae)
  ENST ID: ENST00000543766
  CDS Start-End: 681-815
acagatgcagccacacttgaggtgccactgaagctatgtgaagagcctgctacccttcaaacagaccaggcccaagcaaggtgccaagccatgtgagagtgcccagtccactgtgtaaatgtgacggcctttgatggtagtgtttgaaaagatacttagtagaaagttgcagagacccgggagcagccatttcacaaaagaaggcaaaaatacctttgagaagaaaggaatgtctgcctctgcactatgtatttgcttgtttgtttctccaaataccatctgttgcagactggggtgcatgacattttaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaatggaaacttggcttttgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaa

SEQ ID NO: 198602 - DNA, 377 bp, Homo sapiens
  Payload ID: 19193
  Gene Name: vacuolar protein sorting 13 homolog D (S. cerevisiae)
  ENST ID: ENST00000466732
  CDS Start-End: 1-138
gcactgaccaacatctacaagcatctgatgatcacagctcagagattcacagtgcaaattgaggagaaactgctcctcaagctgctaagtttctttggctacgatcaagcagaatcagatttagaatttaagctttaagagtatttgggatcaagagcaagatcctgtctgtttaatgctgtgttttccactttgggttggaacgccagtgtttatttgtattcagacagccacttgggagcctgcctgccagaggtggaaaaatatgatgaaaacctccatgaaaagacagctgagcaaggtggaacaccaattcgatactactttgaaaatctcaaaatcagcattcctcagatcaagctaagtgtgttcacctc

SEQ ID NO: 198603 - DNA, 16320 bp, Homo sapiens
  Payload ID: 19193
  Gene Name: vacuolar protein sorting 13 homolog D (S. cerevisiae)
  Uniprot ID: Q5THJ4
  ENST ID: ENST00000620676
  CDS Start-End: 131-13297
ggaggaaacgccgcgcagcgccgggctggggcgggcggcccgggacaccgacagatttttctgtgaccatgaaagagagaaataaagaatgatccatgatttctaaacaccttttcctgaggatatagtcatgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaaaaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagcctcccccttgtctaccttagaactaggagtacagccagtctgactaacctagagcaccagatctatgctagagcagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaatggaaacttggcttttgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaa

SEQ ID NO: 198604 - DNA, 16245 bp, Homo sapiens
  Payload ID: 19193
  Gene Name: vacuolar protein sorting 13 homolog D (S. cerevisiae)
  Uniprot ID: Q5THJ4
  ENST ID: ENST00000613099
  CDS Start-End: 131-13222
ggaggaaacgccgcgcagcgccgggctggggcgggcggcccgggacaccgacagatttttctgtgaccatgaaagagagaaataaagaatgatccatgatttctaaacaccttttcctgaggatatagtcatgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaaaaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaacagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaatggaaacttggcttttgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaa

SEQ ID NO: 198605 - DNA, 2750 bp, Homo sapiens
  Payload ID: 19194
  Gene Name: vacuolar protein sorting 16 homolog (S. cerevisiae)
  Uniprot ID: Q9H269
  ENST ID: ENST00000380445
  CDS Start-End: 73-2592
ggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttca

SEQ ID NO: 198606 - DNA, 2318 bp, Homo sapiens
  Payload ID: 19194
  Gene Name: vacuolar protein sorting 16 homolog (S. cerevisiae)
  Uniprot ID: Q9H269
  ENST ID: ENST00000380469
  CDS Start-End: 73-2160
ggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttca

SEQ ID NO: 198607 - DNA, 819 bp, Homo sapiens
  Payload ID: 19194
  Gene Name: vacuolar protein sorting 16 homolog (S. cerevisiae)
  ENST ID: ENST00000417508
  CDS Start-End: 140-819
tctgcaccagccatggactgctacacggcgaactggaacccactcggggactctgccttttaccggaaatatgagctgtacagcatggactgggacctgaaggaggaactcagggattgcctggtggctgctgcaccctatgggggccccattggaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccc

SEQ ID NO: 198608 - DNA, 966 bp, Homo sapiens
  Payload ID: 19194
  Gene Name: vacuolar protein sorting 16 homolog (S. cerevisiae)
  ENST ID: ENST00000453689
  CDS Start-End: 143-966
ccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattggaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaa

SEQ ID NO: 198609 - DNA, 3895 bp, Homo sapiens
  Payload ID: 19195
  Gene Name: vacuolar protein sorting 18 homolog (S. cerevisiae)
  Uniprot ID: Q9P253
  ENST ID: ENST00000220509
  CDS Start-End: 340-3261
gcccgcgtcacgggggcgggagtcagctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaaccgaaatggacagaaggtacggccactagcacgctggaaggggcagctggtggagagtgtgggttggaacaaggcactgggcacggagagcagcacaggccccatcctggtcgggactgcccaaggccacatctttgaagcagagctctcagccagcgaaggtgggcttttcggccctgctccggatctctacttccgcccattgtacgtgctaaatgaagaagggggtccagcacctgtgtgctcccttgaggccgagcggggccctgatgggcgtagctttgttattgccaccactcggcagcgcctcttccagttcataggccgagcagcagagggggctgaggcccagggtttctcagggctctttgcagcttacacggaccacccacccccattccgtgagtttcccagcaacctgggctacagtgagttggccttctacacccccaagctgcgctccgcaccccgggccttcgcctggatgatgggggatggtgtgttgtatggggcattggactgtgggcgccctgactctctgctgagcgaggagcgagtctgggagtacccagagggggtagggcctggggccagcccacccctagccatcgtcttgacccagttccacttcctgctgctactggcagaccgggtggaggcagtgtgcacactgaccgggcaggtggtgctgcgggatcacttcctggagaaatttgggccgctgaagcacatggtgaaggactcctccacaggccagctgtgggcctacactgagcgggctgtcttccgctaccacgtgcaacgggaggcccgagatgtctggcgcacctatctggacatgaaccgcttcgatctggccaaagagtattgtcgagagcggcccgactgcctggacacggtcctggcccgggaggccgatttctgctttcgccagcgtcgctacctggagagcgcacgctgctatgccctgacccagagctactttgaggagattgccctcaagttcctggaggcccgacaggaggaggctctggctgagttcctgcagcgaaaactggccagtttgaagccagccgaacgtacccaggccacactgctgaccacctggctgacagagctctacctgagccggcttggggctctgcagggcgacccagaggccctgactctctaccgagaaaccaaggaatgctttcgaaccttcctcagcagcccccgccacaaagagtggctctttgccagccgggcctctatccatgagctgctcgccagtcatggggacacagaacacatggtgtactttgcagtgatcatgcaggactatgagcgggtggtggcttaccactgtcagcacgaggcctacgaggaggccctggccgtgctcgcccgccaccgtgacccccagctcttctacaagttctcacccatcctcatccgtcacatcccccgccagcttgtagatgcctggattgagatgggcagccggctggatgctcgtcagctcattcctgccctggtgaactacagccagggtggtgaggtccagcaggtgagccaggccatccgctacatggagttctgcgtgaacgtgctgggggagactgagcaggccatccacaactacctgctgtcactgtatgcccgtggccggccggactcactactggcctatctggagcaggctggggccagcccccaccgggtgcattacgacctcaagtatgcgctgcggctctgcgccgagcatggccaccaccgcgcttgtgtccatgtctacaaggtcctagagctgtatgaggaggccgtggacctggccctgcaggtggatgtggacctggccaagcagtgtgcagacctgcctgaggaggatgaggaattgcgcaagaagctgtggctgaagatcgcacggcacgtggtgcaggaagaggaagatgtacagacagccatggcttgcctggctagctgccccttgctcaagattgaggatgtgctgcccttctttcctgatttcgtcaccatcgaccacttcaaggaggcgatctgcagctcacttaaggcctacaaccaccacatccaggagctgcagcgggagatggaagaggctacagccagtgcccagcgcatccggcgagacctgcaggagctgcggggccgctacggcactgtggagccccaggacaaatgtgccacctgcgacttccccctgctcaaccgccctttttacctcttcctctgtggccatatgttccatgctgactgcctgctgcaggctgtgcgacctggcctgccagcctacaagcaggcccggctggaggagctgcagaggaagctgggggctgctccacccccagccaagggctctgcccgggccaaggaggccgagggtggggctgccacggcagggcccagccgggaacagctcaaggctgacctggatgagttggtggccgctgagtgtgtgtactgtggggagctgatgatccgctctatcgaccggccgttcatcgacccccagcgctacgaggaggagcagctcagttggctgtaggagggtgtcacctttgatggggggtgggcaatggggagcagtggcttgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaagtcagaaatctgacccaattccaccccctgcctctagcacctcttctgtccctgtcattccccacacacgtcctgttcacctcgagagagagagagagagagcacctttcttccgtctgttcactctgcggcctctggaatcccagctcttctctctcagaagaagccttctcttcctcctgcctgtaggtgtcccagaagtgagaaggcagccttcgaagtcctgggcattgggtgagaaagtgatgctagttggggcatgcttttgtgcacactctctggggctccagtgtgaagggtgccctggggctgagggccttgtggaggatggtcggtggtggtgatggaggtggagagcattaaactgtctgcactgca

SEQ ID NO: 198610 - DNA, 1050 bp, Homo sapiens
  Payload ID: 19195
  Gene Name: vacuolar protein sorting 18 homolog (S. cerevisiae)
  ENST ID: ENST00000558855
  CDS Start-End: 318-710
tcagctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgagatgggatttcgccatgttgcccagtctggtctcaaactcctgagctcaagcaatctacccacctcggactcccaaagtgctgggattacaggctgagccagtgcacctggcctgtattcagcattttatgcatagatgtatatttcagggaacattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaaccgaaatggacagaaggtacggccactagcacgctggaaggggcagctggtggagagtgtgggttggaacaaggcactgggcacggagagcagcacaggccccatcctggtcgggactgcccaaggccacatctttgaagcagagctctcagccagcgaaggtgggcttttcggccctgctccggatctctacttccgcccattg

SEQ ID NO: 198611 - DNA, 873 bp, Homo sapiens
  Payload ID: 19195
  Gene Name: vacuolar protein sorting 18 homolog (S. cerevisiae)
  ENST ID: ENST00000558474
  CDS Start-End: 303-668
gggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggtggatgtggacctggccaagcagtgtgcagacctgcctgaggaggatgaggaattgcgcaagaagctgtggctgaagatcgcacggcacgtggtgcaggaagaggaagatgtacagacagccatggcttgcctggctagctgccccttgctcaagattgaggatgtgctgcccttctttcctgatttcgtcaccatcgaccacttcaaggaggcgatctgcagctcacttaaggcctacaaccac

SEQ ID NO: 198612 - DNA, 1101 bp, Homo sapiens
  Payload ID: 19196
  Gene Name: vacuolar protein sorting 25 homolog (S. cerevisiae)
  Uniprot ID: Q9BRG1
  ENST ID: ENST00000253794
  CDS Start-End: 41-571
gtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 198613 - DNA, 639 bp, Homo sapiens
  Payload ID: 19196
  Gene Name: vacuolar protein sorting 25 homolog (S. cerevisiae)
  ENST ID: ENST00000589520
  CDS Start-End: 1-334
tcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagt

SEQ ID NO: 198614 - DNA, 668 bp, Homo sapiens
  Payload ID: 19196
  Gene Name: vacuolar protein sorting 25 homolog (S. cerevisiae)
  ENST ID: ENST00000590339
  CDS Start-End: 345-668
cgatgagtttcgagtggccgtggcagtatcgcttcccacccttctttacgtgaggctcagaccccaagaagcaccgctgtgcctccctcccctcccccggaccctgggctcagccctgatgcttcatatggggagggggagaaaagacccgtcggccaacaccctcagtcccttactttcttcctgaaatgcgtcccgggcaagtgctgcctcccgccctctaattctgcgccccactcccttcacccggcaggttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggcccta

SEQ ID NO: 198615 - DNA, 603 bp, Homo sapiens
  Payload ID: 19196
  Gene Name: vacuolar protein sorting 25 homolog (S. cerevisiae)
  ENST ID: ENST00000589577
  CDS Start-End: 8-307
tactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgtatcctccctcaggctcttccacagcccatacacatgcacttctgcgctttcacacatgcccagacgcccccccgcgccagcccccttttacccatgtaagggtcatttgtttttgctgcctgattcatccctaaaatatctgtggagaaaggctgaaggaaggcaacagacagagggaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgagg

SEQ ID NO: 198616 - DNA, 979 bp, Homo sapiens
  Payload ID: 19197
  Gene Name: vacuolar protein sorting 28 homolog (S. cerevisiae)
  Uniprot ID: Q9UK41
  ENST ID: ENST00000292510
  CDS Start-End: 110-775
tgaggggcgaatgccgagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgtctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttcctgcttgggtggctcc

SEQ ID NO: 198617 - DNA, 1097 bp, Homo sapiens
  Payload ID: 19197
  Gene Name: vacuolar protein sorting 28 homolog (S. cerevisiae)
  Uniprot ID: Q9UK41
  ENST ID: ENST00000377348
  CDS Start-End: 110-811
tgaggggcgaatgccgagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgtctggagatccgcgccatggatgagatccagcccgacctgcgagagctgatggagaccatgcaccgcatgagccacctcccacccgactttgagggccgccagacggtcagccagtggtgggtgtccctcccagccaggcagagccccgcagtgcccgagaccctcccagccaggcggagccccgcagtgcccctgaggccctcagcccccacatgccctgtgctgcactcccaggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttcctgcttgggtggctcc

SEQ ID NO: 198618 - DNA, 650 bp, Homo sapiens
  Payload ID: 19197
  Gene Name: vacuolar protein sorting 28 homolog (S. cerevisiae)
  ENST ID: ENST00000533806
  CDS Start-End: 95-650
gagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgtctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtc

SEQ ID NO: 198619 - DNA, 561 bp, Homo sapiens
  Payload ID: 19197
  Gene Name: vacuolar protein sorting 28 homolog (S. cerevisiae)
  ENST ID: ENST00000530790
  CDS Start-End: 403-561
cgctgaccgagcgcaccccgcccccggcgccatcttcccgaccgcgagccgtccagggtcttgctctgtctcccaggctggagtgcagtggctcggtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccagcgcctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggag

SEQ ID NO: 198620 - DNA, 2120 bp, Homo sapiens
  Payload ID: 19197
  Gene Name: vacuolar protein sorting 28 homolog (S. cerevisiae)
  ENST ID: ENST00000526204
  CDS Start-End: 39-146
ccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtaagtccaggcgcccaggctgtcccaacacacccatgcgcatctggctgccctggggcagcccctccagacccaccccaaactgaggggtgggaggacgcagggtcagtctggggaactgttcctgaggcactccaggatggagcaagaggtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctttgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcggtgcgccccagcccccagggcacgtggttaggagagccgaggctgcctgctgcagctgggcacgagcgtagggtcctgggcctccagagctgagcagcactctgacttgctgggcagaagggaacccctttaactaggaatgaggggtgggcagcatgcggggacgcccccaggccacctggactcctgtcggggggatgagcacagggtgcgttctggcggggtcctggcctcgggagagagtgtgggtgtgggcccacccttcagttcccacacagctgtctgggcagccaggacctcgttcacccaggaggcctgcagggtttgggaacagagtacagtgaggaggcccaagtgacagctgtggctgaggaggggttggggcccgtgagccgtggggcctcccgcacccgtggacacgcgagcctcatgtgcacacctgcccccagctcttcatcacggtcatggacaagctgcgtctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgacc

SEQ ID NO: 198621 - DNA, 892 bp, Homo sapiens
  Payload ID: 19197
  Gene Name: vacuolar protein sorting 28 homolog (S. cerevisiae)
  Uniprot ID: Q9UK41
  ENST ID: ENST00000526054
  CDS Start-End: 39-704
ccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgtctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttc

SEQ ID NO: 198622 - DNA, 573 bp, Homo sapiens
  Payload ID: 19197
  Gene Name: vacuolar protein sorting 28 homolog (S. cerevisiae)
  ENST ID: ENST00000531032
  CDS Start-End: 90-573
gctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgtctggagatccgcgccatggatgagatccagcccgacctgcgagagctgatgg

SEQ ID NO: 198623 - DNA, 1010 bp, Homo sapiens
  Payload ID: 19197
  Gene Name: vacuolar protein sorting 28 homolog (S. cerevisiae)
  Uniprot ID: Q9UK41
  ENST ID: ENST00000529182
  CDS Start-End: 39-740
ccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgtctggagatccgcgccatggatgagatccagcccgacctgcgagagctgatggagaccatgcaccgcatgagccacctcccacccgactttgagggccgccagacggtcagccagtggtgggtgtccctcccagccaggcagagccccgcagtgcccgagaccctcccagccaggcggagccccgcagtgcccctgaggccctcagcccccacatgccctgtgctgcactcccaggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttc

SEQ ID NO: 198624 - DNA, 1613 bp, Homo sapiens
  Payload ID: 19197
  Gene Name: vacuolar protein sorting 28 homolog (S. cerevisiae)
  ENST ID: ENST00000530836
  CDS Start-End: 39-146
ccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtaagtccaggcgcccaggctgtcccaacacacccatgcgcatctggctgccctggggcagcccctccagacccaccccaaactgaggggtgggaggacgcagggtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctttgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgtctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagat

SEQ ID NO: 198625 - DNA, 4586 bp, Homo sapiens
  Payload ID: 19198
  Gene Name: vacuolar protein sorting 33 homolog A (S. cerevisiae)
  Uniprot ID: Q96AX1
  ENST ID: ENST00000267199
  CDS Start-End: 114-1904
gtgcgctgccgtaccggtcacgtggacgtttggtcacgtgactgcgtccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatgaaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattccctttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgagactgaggaggtgaaactgaaaataaaaagagaaagttcatcctctaatccccagtgctgtatttcttcaaggcgcatcaggcctaggacagtggttaagtgttgggagctggagatcattttatcactgagttgagatttctttttcctgcagagtgtgggagattatatttagggtcatcagtcactgtcgcaactgatcactaaggcaagtttgcttccttctacttcttacaaagcaagaggtttaggggagcttcttgcccagaaacaaagtttatgctctatgtgatcagctacatctccttaggttccatacttatcaggggcttttgacatggaagaatgtgataattggggagcaaccttctgagaattcagcctttgaagtaattcaaagacagtttcttagcacacacgttaactccagacacagcagtggtgggtgcctccattgaggtttccgttttctcttctgtccatcaagggcccaacatccaactggtcccacagtgagcaggggcaactcttgcttcttcagcatctggccacttcgtttccatggtaactgccacgtgtacttttctagcagtctgtggccactccgtactcagctgaaaacactgtttcagccccctctctggtgacctcagccttctccaggtgtatctcttgatgatcttggagaccagcagccacagctgctgctactcctgcaggagactgtcaggctgtggtggggggcaggggtgttggaggagaagttgaaaatccgtgtgttctctgcccctctgctcctccatcttagcttctggaggagttaaggcaccaagggcaccaagtcaggttggcagttttgctgcccttgcccaagcctccagcaaaactagctggtcccctgctttgctgggtcccagccaggtgtgattttggttgttgattagtaaccacacattgtttttccccacctttttcattagtggaggtttttgttttgttttgtttttgtttgtttgagacagagtctcacgctcttttcagactggagtgcagtggtgcgatgtcagctcactgcaacctccacttcccgggttcagacgattctcatgcctcagcctcctgagtagctgggattacagatgtgcaccaccacacctggctaatttttgtatttttagtagagatggggtttcaccatattggccaggctggtctcaaactcctgacctcaggcgattggcccacctcggcctcccaaagtgctgggattacaggtgtgaaccaccgtgcccggcccattagtggagttctgatgggcacggtaaatattattaatgaaagagaaattctgtatacttttttaaaaatctctttaatgaaagaatgaagagtggcagagataataattgaaagattagtttctcatggaattaatttggccttgatattcagtatttggaaatgtcttaaagaaaaccattttcattgtagaaaatccttttttaaatacttgttatatcccagggagattagtttataccttccacctcaggcagtcatcagctgctttagagaatggaatccaccctgcccctccattttttggttcctggggctcaattcaagtctggtcaagtctccctggctggggattctgtcctgggaacagatactcagttgtagtctcatgtgtctgcactcacccaagactctatatacttgcttgctcagagcatagttagggcagctcctaaaaatgcattcagcagaagactgaaaaacttcaattgcttcatttgtatgcaaatagaaaatggtagataattatatattatacgcctttgtgtaagttcatttaatacttgaagcagtctttgtctcaaaagagtatgcccttactgagaaaggatatgtgaacggtacatttattgttggggagagtggattgtttacatcatgtctggacttttgtctagttgggtagacagttctacaccagcagcccccttaataaagaagtctacacagaca

SEQ ID NO: 198626 - DNA, 567 bp, Homo sapiens
  Payload ID: 19198
  Gene Name: vacuolar protein sorting 33 homolog A (S. cerevisiae)
  ENST ID: ENST00000536212
  CDS Start-End: 106-567
aatgcactcttccagtttttctccttttttacttttttgattgtctttctggttttagacaaattttaaaatctgcttgttcccaggggggccccacctcatccaatgttttgtttccagcaagtggccaatatgatgatcaggatgaagagagagtttacaggaagccagaattcaatatttcctgtttttgataatctcttgttgcttgatcggaatgtggatttattaacacctcttgccactcagctgacatatgaaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggc

SEQ ID NO: 198627 - DNA, 2019 bp, Homo sapiens
  Payload ID: 19198
  Gene Name: vacuolar protein sorting 33 homolog A (S. cerevisiae)
  ENST ID: ENST00000543633
  CDS Start-End: 32-160
ggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaagggtttatcagtcaccctaagttactgacagtacaactgtgaaaagtcgaactggggagcctcagtcttgtagagaacagaaccccaagaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatgaaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaata

SEQ ID NO: 198628 - DNA, 1154 bp, Homo sapiens
  Payload ID: 19198
  Gene Name: vacuolar protein sorting 33 homolog A (S. cerevisiae)
  ENST ID: ENST00000451053
  CDS Start-End: 9-569
ggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaatcttgctctgttgccccggctggagtgcagtggcacaatctcagctcactgcaacctccacctcctgagttcaagtgattctgctgcctcagtcacctgagtagctgggattacaggcacatgccaccacacctggctaatttttgtatttttagtagagaaggggtttcaccattttggtcaggctggtctagaactcccgacctcatgatcctccccgctcagcctcccaaagtgctgggattacaggcgtgagccaccgcacccagccctcaatgtcttttgcccttgaacgttcatctgatctggagttttaagtggttttgccaaaaagcgtgtcttttgacatattctcgatggtctgccatattcagggaaacgttaaaatataccacacttgaaagagtagtccggcgacactctcaataataaccaaacgctccccaccatgtctgccatccttcctccctggggcagagggcctgacaagtgacaaccccgctctctcttcctcaggccctggaccctcagggccccctcagttctggctgtggacagcagggacatgttgggttggtaggggtggagggaattgataaaatgtaccatattgacttatgagtggataatggttgtaaaaaaacctaaataattccaaataaa

SEQ ID NO: 198629 - DNA, 2767 bp, Homo sapiens
  Payload ID: 19199
  Gene Name: vacuolar protein sorting 33 homolog B (yeast)
  Uniprot ID: Q9H267
  ENST ID: ENST00000333371
  CDS Start-End: 355-2208
gagatctaggaagtcgcttctttttctggtagaaggcggggttctcctcgtacgctgcggagtctctgcggggtgtagaccggaatcctgctgacgggcagagtggatcagggagggagggtcgagacacggtggctgcaggtctgagacaaggctgctccgaggtagtagctctcttgcctggaggtggccattcattcctggagtgctgctgaggagcgagggcccatctggggtctctggaagtcggtgcccaggcctgaaggatagccccccttgcgcttccctgggctgcggccggccttctcagaacgaagggcgtccttccaccccgcggcgcaggtgaccgctgccatggcttttccccatcggccggacgcccctgagctgcctgacttctccatgctgaagaggctggctcgagaccagctcatctatctgctggagcagcttcctggaaaaaaggatttattcattgaggcagatctcatgagccctttggatcgaattgccaatgtctccatcctgaagcaacacgaagtagacaagctatacaaggtggagaacaagccagccctcagctccaatgaacaattgtgcttcttggtcagaccccgcatcaagaatatgcgatacattgccagtcttgtcaatgctgacaaattggctggccgaactcgcaaatacaaagtgatcttcagccctcaaaagttctatgcgtgtgagatggtgcttgaggaagagggaatctatggagatgtgagctgtgatgaatgggccttctctttgctgcctcttgatgtggatctgctgagcatggaactaccagaatttttcagggattactttctggaaggagatcagcgttggatcaacactgtagctcaggccttacaccttctcagcactctctatggaccctttccaaactgctatggaattggcaggtgcgccaagatggcatatgaattgtggaggaacctggaggaggaggaggatggcgaaaccaagggccgaaggccagagattggacatatctttctcttggacagagatgtggactttgtgacagcactttgctcccaagtggtttatgagggcctagtagatgacaccttccgcatcaagtgtgggagtgtcgactttggcccagaagtcacatcctctgacaagagcctgaaggtgctactcaatgccgaggacaaggtgtttaatgagattcggaacgagcacttctccaatgtctttggcttcttgagccagaaggcccggaacttgcaggcccagtatgatcgccggagaggcatggacattaagcagatgaagaatttcgtgtcccaggagctcaagggcctgaaacaggagcaccgcctgctgagtctccatattggggcctgtgaatccatcatgaagaagaaaaccaagcaggatttccaggagctaatcaagactgagcatgcactgctagaggggttcaacatccgggagagcaccagctacattgaggaacacatagaccggcaggtgtcgcctatagaaagcctgcgcctcatgtgccttttgtccatcactgagaatggtttgatccccaaggattaccgatctctgaaaacacagtatctgcagagctatggccctgagcacctgctaaccttctccaatctgcgaagagctgggctcctaacggagcaggcccccggggacaccctcacagccgtggagagtaaagtgagcaagctggtgaccgacaaggctgcaggaaagattactgatgccttcagttctctggccaagaggagcaattttcgtgccatcagcaaaaagctgaatttgatcccacgtgtggacggcgagtatgatctgaaagtgccccgagacatggcttacgtcttcggtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgtaatacgttggtcgttctggacacgcacttccatctttattagtgaaagcccattggagcttgctacaggggcttcctgtgcttcttggcctggactttgtagtggctccaggcctggtctggttcttccctgtaaaaatcactctaccactctgtacctgagtttcctctaccataaaatgagggagatggctgaggtgaccagcaagcacgtttccagttctaaaatgttgtgattcattacatttttgagaaaatga

SEQ ID NO: 198630 - DNA, 2420 bp, Homo sapiens
  Payload ID: 19199
  Gene Name: vacuolar protein sorting 33 homolog B (yeast)
  ENST ID: ENST00000535906
  CDS Start-End: 348-2120
aggaagtcgcttctttttctggtagaaggcggggttctcctcgtacgctgcggagtctctgcggggtgtagaccggaatcctgctgacgggcagagtggatcagggagggagggtcgagacacggtggctgcaggtctgagacaaggctgctccgaggtagtagctctcttgcctggaggtggccattcattcctggagtgctgctgaggagcgagggcccatctggggtctctggaagtcggtgcccaggcctgaaggatagccccccttgcgcttccctgggctgcggccggccttctcagaacgaagggcgtccttccaccccgcggcgcaggtgaccgctgccatggcttttccccatcggccggacgcccctgagctgcctgacttctccatgctgaagaggctggctcgagaccagctcatctatctgctggagcagcaacacgaagtagacaagctatacaaggtggagaacaagccagccctcagctccaatgaacaattgtgcttcttggtcagaccccgcatcaagaatatgcgatacattgccagtcttgtcaatgctgacaaattggctggccgaactcgcaaatacaaagtgatcttcagccctcaaaagttctatgcgtgtgagatggtgcttgaggaagagggaatctatggagatgtgagctgtgatgaatgggccttctctttgctgcctcttgatgtggatctgctgagcatggaactaccagaatttttcagggattactttctggaaggagatcagcgttggatcaacactgtagctcaggccttacaccttctcagcactctctatggaccctttccaaactgctatggaattggcaggtgcgccaagatggcatatgaattgtggaggaacctggaggaggaggaggatggcgaaaccaagggccgaaggccagagattggacatatctttctcttggacagagatgtggactttgtgacagcactttgctcccaagtggtttatgagggcctagtagatgacaccttccgcatcaagtgtgggagtgtcgactttggcccagaagtcacatcctctgacaagagcctgaaggtgctactcaatgccgaggacaaggtgtttaatgagattcggaacgagcacttctccaatgtctttggcttcttgagccagaaggcccggaacttgcaggcccagtatgatcgccggagaggcatggacattaagcagatgaagaatttcgtgtcccaggagctcaagggcctgaaacaggagcaccgcctgctgagtctccatattggggcctgtgaatccatcatgaagaagaaaaccaagcaggatttccaggagctaatcaagactgagcatgcactgctagaggggttcaacatccgggagagcaccagctacattgaggaacacatagaccggcaggtgtcgcctatagaaagcctgcgcctcatgtgccttttgtccatcactgagaatggtttgatccccaaggattaccgatctctgaaaacacagtatctgcagagctatggccctgagcacctgctaaccttctccaatctgcgaagagctgggctcctaacggagcaggcccccggggacaccctcacagccgtggagagtaaagtgagcaagctggtgaccgacaaggctgcaggaaagattactgatgccttcagttctctggccaagaggagcaattttcgtgccatcagcaaaaagctgaatttgatcccacgtgtggacggcgagtatgatctgaaagtgccccgagacatggcttacgtcttcggtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgt

SEQ ID NO: 198631 - DNA, 2356 bp, Homo sapiens
  Payload ID: 19199
  Gene Name: vacuolar protein sorting 33 homolog B (yeast)
  ENST ID: ENST00000574755
  CDS Start-End: 265-507
ctgacgggcagagtggatcagggagggagggtcgagacacggtggctgcaggtctgagacaaggctgctccgaggtagtagctctcttgcctggaggtggccattcattcctggagtgctgctgaggagcgagggcccatctggggtctctggaagtcggtgcccaggcctgaaggatagccccccttgcgcttccctgggctgcggccggccttctcagaacgaagggcgtccttccaccccgcggcgcaggtgaccgctgccatggcttttccccatcggccggacgcccctgagctgcctgacttctccatgctgaagaggctggctcgagaccagctcatctatctgctggagcagcttcctggaaaaaaggatttattcattgaggcagatctcatgagccctttggatcgaattgccaatgtctccatcctgaagattgtgcttcttggtcagaccccgcatcaagaatatgcgatacattgccagtcttgtcaatgctgacaaattggctggccgaactcgcaaatacaaagtgatcttcagccctcaaaagttctatgcgtgtgagatggtgcttgaggaagagggaatctatggagatgtgagctgtgatgaatgggccttctctttgctgcctcttgatgtggatctgctgagcatggaactaccagaatttttcagggattactttctggaaggagatcagcgttggatcaacactgtagctcaggccttacaccttctcagcactctctatggaccctttccaaactgctatggaattggcaggtgcgccaagatggcatatgaattgtggaggaacctggaggaggaggaggatggcgaaaccaagggccgaaggccagagattggacatatctttctcttggacagagatgtggactttgtgacagcactttgctcccaagtggtttatgagggcctagtagatgacaccttccgcatcaagtgtgggagtgtcgactttggcccagaagtcacatcctctgacaagagcctgaaggtgctactcaatgccgaggacaaggtgtttaatgagattcggaacgagcacttctccaatgtctttggcttcttgagccagaaggcccggaacttgcaggcccagtatgatcgccggagaggcatggacattaagcagatgaagaatttcgtgtcccaggagctcaagggcctgaaacaggagcaccgcctgctgagtctccatattggggcctgtgaatccatcatgaagaagaaaaccaagcaggatttccaggagctaatcaagactgagcatgcactgctagaggggttcaacatccgggagagcaccagctacattgaggaacacatagaccggcaggtgtcgcctatagaaagcctgcgcctcatgtgccttttgtccatcactgagaatggtttgatccccaaggattaccgatctctgaaaacacagtatctgcagagctatggccctgagcacctgctaaccttctccaatctgcgaagagctgggctcctaacggagcaggcccccggggacaccctcacagccgtggagagtaaagtgagcaagctggtgaccgacaaggctgcaggaaagattactgatgccttcagttctctggccaagaggagcaattttcgtgccatcagcaaaaagctgaatttgatcccacgtgtggacggcgagtatgatctgaaagtgccccgagacatggcttacgtcttcggtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgt

SEQ ID NO: 198632 - DNA, 4417 bp, Homo sapiens
  Payload ID: 19200
  Gene Name: vacuolar protein sorting 36 homolog (S. cerevisiae)
  Uniprot ID: Q86VN1
  ENST ID: ENST00000378060
  CDS Start-End: 29-1189
ggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgtttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaacaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacatagcaa

SEQ ID NO: 198633 - DNA, 4607 bp, Homo sapiens
  Payload ID: 19200
  Gene Name: vacuolar protein sorting 36 homolog (S. cerevisiae)
  Uniprot ID: Q86VN1
  ENST ID: ENST00000611132
  CDS Start-End: 393-1379
gcggccgcttccctccgcccggaatgcttccgggagcgcacagctgcagtgcccgggagaaggagcgctcgccgtctgcgggcgccgggcggcgatccggcagtcgacttccttggcgtggttccagaccccctgacgacaccaacctcggcgtcggcaccggacagccccgtttcgcctttctgtgaggagggcgcggtggccgtacagtccgtgccccagcggaagctttagcttggaccttatgcagtcggagggattagcatatctgggcagaggggtgagggattgcttcgaaaggatttcctaaagagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgtttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaacaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacatagcaa

SEQ ID NO: 198634 - DNA, 4906 bp, Homo sapiens
  Payload ID: 19201
  Gene Name: vacuolar protein sorting 37 homolog A (S. cerevisiae)
  Uniprot ID: Q8NEZ2
  ENST ID: ENST00000324849
  CDS Start-End: 675-1868
agctggcgccatcgcgcaccctctcaggttcatcgtccccgccccctttctacttccctaacccgcccctccccccgtaaggctgcagcggatgcaagatctacttgtgtcgctgagctcgcgctcctcctcctcctcctcgccatagagacagcactcggcggcggtggcggtggcggtggcggtagcggcggcggcagcgggtgccccatagacacctctcgcccagcgaagggaaaggcgagcaggagctgcgccgcaccgtgctgcgccgtcgcttttcgcacgtcctgacgggggcgctagatgatgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttctttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcagtgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctatatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcata

SEQ ID NO: 198635 - DNA, 4051 bp, Homo sapiens
  Payload ID: 19201
  Gene Name: vacuolar protein sorting 37 homolog A (S. cerevisiae)
  Uniprot ID: Q8NEZ2
  ENST ID: ENST00000425020
  CDS Start-End: 152-709
ggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttaccagctagaaatcaggtggcaccatccgcactgcctggaaatctccttagctagatcatccaattcactagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataaggtgagttagtgataattttgaagaaatttacataatttaaaaatagaataaaacaaccttttcattttctcttttagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttctttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcagtgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaa

SEQ ID NO: 198636 - DNA, 2102 bp, Homo sapiens
  Payload ID: 19201
  Gene Name: vacuolar protein sorting 37 homolog A (S. cerevisiae)
  ENST ID: ENST00000520140
  CDS Start-End: 312-1265
tgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaaggtcactgtataactgtgaacacttccccacggttgtgatttttaaagaaagtagatatatcgatatatccattggaccaaaatttacttttacagattctgtcaagaatatattacagactgctctatgttccattgtggttgatgttttatttgattttaaggttaaaactggcagccttaggtgtatatgtaaaaattatttagaaccctatcagttaactaaagctgaaaaattgtaaatagttgtcatggagaaaaactcgatgtctgatatttattgacattttttcttttgtgtttctagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgta

SEQ ID NO: 198637 - DNA, 575 bp, Homo sapiens
  Payload ID: 19201
  Gene Name: vacuolar protein sorting 37 homolog A (S. cerevisiae)
  ENST ID: ENST00000519381
  CDS Start-End: 315-476
aagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagatacaagttatgctggctatccagattctgtgattaaaaataaagtatagccgaaatacagaaagatgtggaatacagattgccattcaccataaacaacctgacaattaacattaatatattgcttcctccacag

SEQ ID NO: 198638 - DNA, 1307 bp, Homo sapiens
  Payload ID: 19201
  Gene Name: vacuolar protein sorting 37 homolog A (S. cerevisiae)
  Uniprot ID: Q8NEZ2
  ENST ID: ENST00000521829
  CDS Start-End: 123-1241
cccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatattt

SEQ ID NO: 198639 - DNA, 697 bp, Homo sapiens
  Payload ID: 19201
  Gene Name: vacuolar protein sorting 37 homolog A (S. cerevisiae)
  ENST ID: ENST00000521976
  CDS Start-End: 1-513
cctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactataggtaaattgtatttcaagtttgagtctcaaggtgattgcatcagtgttctttaaatagacatgttgttaacggtgcctgttcatcagccttaagcataattctgtcattatagttactgtgctatgtaacatagaatgctttgtattatataataagcataatataaacatataactagtagaaa

SEQ ID NO: 198640 - DNA, 655 bp, Homo sapiens
  Payload ID: 19201
  Gene Name: vacuolar protein sorting 37 homolog A (S. cerevisiae)
  ENST ID: ENST00000518038
  CDS Start-End: 308-655
ggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccaggctggagcgcagtggcgcgatctcggttcactgcaacctccgtctcccggattcaagcaatcatcctccctcagctccccacacccctccgagtagctgggattacagattgcttcctccacagtttcctcaggaaaaaccagtgatcagtgtttatccaccaatacgacatcacttaatggataaacaaggagtgtatgttacctctccattagtaaacaat

SEQ ID NO: 198641 - DNA, 479 bp, Homo sapiens
  Payload ID: 19201
  Gene Name: vacuolar protein sorting 37 homolog A (S. cerevisiae)
  ENST ID: ENST00000521005
  CDS Start-End: 2-232
gatgagctggctttttcccctgaccaagagcgcctcctcctccgcggctgggtcccccggtggcctcaccagcctccagcagcagaagcagcgcctgatcgagtccctccggaactcacactccagtctatttccagtatcccttgctgcccaggcttcgccactgatctttccctttgcccacctgattgccgcgtcagcagaattgttaaaatacaattgtgaagagtaatctccaggtttcacaaagaatggaaaatagaactgttgcaacatcaaaggaaagggaagccagagttttcatcagtgaatgcttctcgtctgagagtcacttatcacgtagtcagtcttcttgagtctctaagatttaccctgttggagcagtctctccccatctcacagcgaccagtgcatgtacatttctcacttctttcatagtcttgtccccacgctcaagaattactttatgttcatcttga

SEQ ID NO: 198642 - DNA, 3028 bp, Homo sapiens
  Payload ID: 19202
  Gene Name: vacuolar protein sorting 37 homolog B (S. cerevisiae)
  Uniprot ID: Q9H9H4
  ENST ID: ENST00000267202
  CDS Start-End: 383-1240
gggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgccttgacccaggctacccttagccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccagggcccagcagggggcagtggcacctgttgacggaaaaggccgaggtgcttaccagtggaccttctggcccgcccctcccctgtcacttgtcgggcatccagggccccgacctgtgcctagccgccagggtgacagaaggcagaactgaagcggggtctgggccacgggccaggccactgccttttgtcctcagtgaccgtacattcctgctctcggacttgaactctactgtaactgttttcttaaaggaaatgaagctgtacaggacgattcactgccatgccagtcaggcgggcttgccatgttctgtgaatctcgagtgagcggtgccacccgcccccatacctccgccaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattattaataaca

SEQ ID NO: 198643 - DNA, 2088 bp, Homo sapiens
  Payload ID: 19202
  Gene Name: vacuolar protein sorting 37 homolog B (S. cerevisiae)
  ENST ID: ENST00000371248
  CDS Start-End: 1536-2088
aataatatctaccagagggcacagagaataaggaactttgtctacctgctacccagccgaggaagtaaacactgccaaccggcggaaccccccgccttgtgctctgccctcagtgtgctcttccccatgtccactgttgtgaattatttatttctctaagtaggcttttgatggacaaaaatgggggctcaggaggaagtgacacaggcacagaggcaggaaagcagggatgggttgtccgacgagcgagttctcgtctactttggccagatggcatgtacttgtgtgtagagaaatgacaagaaatagggctggtgagggggagtgccagggtgtgcgccccatggtggttaatttaggaggaaacaaggagcttcgtgatgattttggagcagagaagcagtcggatgaaactgctcttttttttttttttttttgagaccgagttttgctcttgtctcccaggctggagtgcaatggcacaatctcggctcaccgcaacctctgcctcccggattcaagcgattctcctgcctcagcctcccaagtagctgggattacaggcacgcgccaccatgctcggctaattttgtatttttagtagagatggggtttctccatgttggtcgggctggtctagaactcctgacctcaggtgatccgtccgcctcggcctcccaaagtgctgggattacaggcgtgagccaccgcgcccggcctgaaactgctctttagggaggttaatctgtcagcaaagcgtgggctggcttggcgtggcaggaccaggttggcggcggaagtggaggttaggaagaaattaggatttgagctagggctctgggagaggtattcggaccagctggcccgactccctttctcacttcccctctcctgctgacctgaagtgctttccccacctctgtcacaggcacgtggtctcttagcttctttgtatacctctcctgtggcacttgacacacattttgtaagtcacttccctgtgtcccccactggcttgggggctgcattttgtcatgtttgtctttttgtccttggcacccagcacagtgcctggcacccaggatgtgcctgggtagtgctgctgagtgagtggtgataaccgggcttcaagtggaagtgagtaggagacagggctctggtgagcggggaggggaggggcagtgggggtgcaggagggagggagtcattgaggccggattaggcagagcatgagggatgggcagggctttgtcccgcaggcagttggagtgtggttctggagctcagggtgaatgctctgcttggagacagaaattcaagccactctcctccaagtgcttgtggaaatcaaggagaatataaaagtttgaaaggccactaggagctattagtgggttgggagaaggaaagagctgccatcgaagggaggggagaaacgagagaaacaagttggatgacctaacatcctgttagagactggctggaagaggaacccagaagtagactgcactgtttgaccctcaccggtcggtcgtatgcagagtggttgtgttcttgagctgaggaatgccggccttgttgcctgtttggctttgattacagtatttgtagcagaatgttgctatggagattcatgccagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccg

SEQ ID NO: 198644 - DNA, 879 bp, Homo sapiens
  Payload ID: 19202
  Gene Name: vacuolar protein sorting 37 homolog B (S. cerevisiae)
  ENST ID: ENST00000535765
  CDS Start-End: 66-879
ggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgcccc

SEQ ID NO: 198645 - DNA, 2865 bp, Homo sapiens
  Payload ID: 19203
  Gene Name: vacuolar protein sorting 37 homolog C (S. cerevisiae)
  Uniprot ID: A5D8V6
  ENST ID: ENST00000301765
  CDS Start-End: 234-1301
gtggcccgggcggccgcgagcgtgtgtgtgtggcacgatgtcgtggtaactcagaggcgcgcgaggcggggcggccaacggggtcgcggggcgagcacgcgcgccactggggcgccggacgttgcaagggggtcacatccggtagggggcgggcctggcggaccccggaagtgtgggcgcggctgcggtttaacccgcggtggcggcggcgacggcggccctggcagggaaggatggagacgctgaaggataagaccctgcaggagctggaggagttgcagaatgactcggaggcgattgaccagctggccctggagtcccctgaggtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggttcgcgtggaaaagctccaggaagtggtgaggaagcccagggcttcccaggagctggccggcgatgcccctccaccccgtccaccacccccggtgcgcccagtcccccagggaacaccccctgtggttgaagagcagccgcagccaccattagccatgcctccctaccctttgccctacagcccatcccccagcctgcctgtgggccccactgcccatggagccctgccaccggcccctttcccagtagtgtcccagccctccttctacagcgggcctctgggccccacttacccggcagcccagcttggacccaggggtgctgcgggttactcctggtccccacagaggagcatgccaccccggccgggctatcctgggaccccaatgggtgcctctgggcctgggtaccccttgcggggaggcagggcccccagtcctggttatcctcaacagtccccataccccgcaacaggaggaaaacctccctacccaatacagcctcagctccccagctttccaggccagccccagccctcagtgcccctgcagcccccttatccccccgggcccgcccctccctatgggttcccaccaccgccggggcctgcctggcctgggtattagacacactcctggccctcggcccctccctagtcccacccacgctcaacctttggcccagccatcgccgagattcgagggtcaactggaagtggcgttggtgctccctgtggacttgcgtcggcacccagaggccttggagggacaaggcactgggcggtgtgactggtcatggcacttgctggccttctggccagaggtcctcctggaagcccctcctttcagtgcctggctgcagcggtgctagccaggctggagtccagcacctctcgccggtgtctgtgtgagtgagcgcatgtgcgcatttatgagcatctacttgcggctgcactcagggccatttgaacccagtgcagagttatctctatgaggaggccccgggtctccagccccctccatctcccctggggtttggcatatttgacatggagccccatgccaagggatgcagctgttggtgtctgtccagtccattcaaggctagcctgcccatgcactgtggcaggggttggattggagggagagaacagagttgggaaaaacaacaggtttgagtcctataaagccataatttaactccagtagctgatgtcagacaagcttgtcctatgtcctatttgagtggcagcagcgccagcccagcaagaaggctgggggttgtcaaggttgtccccagaccttgcttgcagtggttggagaacccagggggctgccttgggccctctggccagagggaagcgggcagctctagccctggagattgtggtcacattggggcttgtttaggattggagggccaggtcacctccccagccaccctcccttctctcctctggggtccccactttagggcgactttgcccgaggcccacgcatccatccactcctttagtgccttgaatctcattcacaagcagccccctcccttcccctccccttctcactctgttgatgtaatcctcccacccccagtgtccatcctaagacaggcatcaaaagaggccctaactttacttcccaaatggtgctttttaaaaaacaccatcactacattaggggcaattttttcacacctccctgtcttcagaatgtaaagggtggggattatgtctctgtttaatatgcagccccctgcactgtggggtttggggcatgttcagtaataagaatgaatacaatagacaaagggggtgtgatgagtgttaacttggttgttccagaggtaaaccaggtctcagggaagagcctggagctgctattgcttaggaagttgtacgtgccttgaaatgtccactacctgaggacgcagcatctggtgggcccggggctgctggggccaaggagggaccttgaccttctggtgcctgcccctccccggcctatgtgccatccgcgtgacgctaggtcagcgctgccggttctttaccaaatgtgcttgcttctcctaagttatttataaagagaaatcactaatggactctactggtttgagtgcttctgagctggatgaccgaccgcctgtatgtttgtgtaattaattgccataataaactttgatgagtcacat

SEQ ID NO: 198646 - DNA, 506 bp, Homo sapiens
  Payload ID: 19203
  Gene Name: vacuolar protein sorting 37 homolog C (S. cerevisiae)
  ENST ID: ENST00000538036
  CDS Start-End: 63-506
ccccaccactcaccgccaccctcctttctgcgtctctgcaggccctcgtcccatatggaaggatggagacgctgaaggataagaccctgcaggagctggaggagttgcagaatgactcggaggcgattgaccagctggccctggagtcccctgaggtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggtt

SEQ ID NO: 198647 - DNA, 1624 bp, Homo sapiens
  Payload ID: 19204
  Gene Name: vacuolar protein sorting 37 homolog D (S. cerevisiae)
  Uniprot ID: Q86XT2
  ENST ID: ENST00000324941
  CDS Start-End: 135-890
ggcggcggagcggtgcgtgcggccggagccggagcggatcctggagccggagcggagcggagcggagcggagccggggcggagcgggccgagcgggccgagccagcagccgagctgggggcgcgggcgggcggcatgtaccgggcccgggcggcgcgggcggggccggagcccggcagcccggggcgctttgggatcctcagcaccgggcagctccgggacctgcttcaggatgagcccaagctggaccggatcgtgcggctcagcaggaagttccagggcctgcagctggagcgtgaggcctgcctggcctccaactacgcgctggccaaggagaacctggccctgcggccccgcctggagatgggccgggctgccctggccatcaaataccaggagcttcgtgaggtggccgagaactgcgcggacaagctgcagcgactggaggaaagcatgcatcgctggagtccccactgcgcgctgggctggctgcaggctgagctagaagaggcggagcaggaggcagaggagcagatggagcagctgctgctcggggagcaaagcctggaggccttcctgcctgccttccagcgtggccgcgccctggcccacctgaggcggacgcaggcagagaagctgcaggagctgctgcggcgtcgggagcgttctgcccagccggcccccacctcggctgctgatccccccaaatccttcccggctgcagctgtcctgcccactggggccgcccgggggccaccagcagtgccccggagcctgccccccttggactcccgcccagtgcccccactgaagggctcccccgggtgccccctcggcccggcccccctgctgagccctcggccctcgcagccagagcccccccaccggtaggatccacggtgcggccccccagttggggggcctagacaaacttgatgcgtggctcctcctcctcccccactgcctgggtggggggaggggcaggcccctccccctggcctcaggcaggccctggccctggaggctgagctggggaggagggtcccctggaagaggcccgagagggggctgggggtgggtgggcagggctttatgcctctggcgctgaagacaccctgccttttttgtttccgtgccccggggcctctagggtgatggaccagccccgttaaagaacttgactcaactacaggggcctgggaagatgcctgggtcccctaggggccttgccaaggggacctgtcgcaccccaccactccactgggctcgcacaacgccaaggccgccaggagtgttttacatcatgtcctgagcctacctttcccccaaattctggggcccacagcctaggagccaggtgatcaggcctcggctgtggggccagggacaccatggccctggggctactacgtgtccacacatgctccagaccctggggcaaggtaggccaggggcttctgacctgtgcaggtgagagtgggccatacccaggaaagaccattctgtatttttctgtccctgtctccttagaatggaagctttttgagggcaggtccttgtctttgtacgttctgtccccagccccgcctcttaggggccgtcaataaatgtgatgatgaggatga

SEQ ID NO: 198648 - DNA, 1303 bp, Homo sapiens
  Payload ID: 19204
  Gene Name: vacuolar protein sorting 37 homolog D (S. cerevisiae)
  ENST ID: ENST00000451519
  CDS Start-End: 67-567
ggagccggggcggagcgggccgagcgggccgagccagcagccgagctgggggcgcgggcgggcggcatgtaccgggcccgggcggcgcgggcggggccggagcccggcagcccggggcgctttgggatcctcagcaccgggcagctccgggacctgcttcaggatgagcccaagctggaccggatcgtgcggctcagcaggaaggagcagatggagcagctgctgctcggggagcaaagcctggaggccttcctgcctgccttccagcgtggccgcgccctggcccacctgaggcggacgcaggcagagaagctgcaggagctgctgcggcgtcgggagcgttctgcccagccggcccccacctcggctgctgatccccccaaatccttcccggctgcagctgtcctgcccactggggccgcccgggggccaccagcagtgccccggagcctgccccccttggactcccgcccagtgcccccactgaagggctcccccgggtgccccctcggcccggcccccctgctgagccctcggccctcgcagccagagcccccccaccggtaggatccacggtgcggccccccagttggggggcctagacaaacttgatgcgtggctcctcctcctcccccactgcctgggtggggggaggggcaggcccctccccctggcctcaggcaggccctggccctggaggctgagctggggaggagggtcccctggaagaggcccgagagggggctgggggtgggtgggcagggctttatgcctctggcgctgaagacaccctgccttttttgtttccgtgccccggggcctctagggtgatggaccagccccgttaaagaacttgactcaactacaggggcctgggaagatgcctgggtcccctaggggccttgccaaggggacctgtcgcaccccaccactccactgggctcgcacaacgccaaggccgccaggagtgttttacatcatgtcctgagcctacctttcccccaaattctggggcccacagcctaggagccaggtgatcaggcctcggctgtggggccagggacaccatggccctggggctactacgtgtccacacatgctccagaccctggggcaaggtaggccaggggcttctgacctgtgcaggtgagagtgggccatacccaggaaagaccattctgtatttttctgtccctgtctccttagaatggaagctttttgagggcaggtccttgtctttgtacgttctgtccccagccccgcctcttaggggccgtcaataaatgtgatgatgaggatgacg

SEQ ID NO: 198649 - DNA, 4844 bp, Homo sapiens
  Payload ID: 19205
  Gene Name: vacuolar protein sorting 39 homolog (S. cerevisiae)
  Uniprot ID: Q96JC1
  ENST ID: ENST00000318006
  CDS Start-End: 164-2791
agcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttggttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaagccta

SEQ ID NO: 198650 - DNA, 2661 bp, Homo sapiens
  Payload ID: 19205
  Gene Name: vacuolar protein sorting 39 homolog (S. cerevisiae)
  Uniprot ID: Q96JC1
  ENST ID: ENST00000348544
  CDS Start-End: 1-2661
atgcacgacgctttcgagccagtgccgatcctagaaaagctgcctctgcaaatcgactgtctggctgcctgggaggaatggcttcttgtgggaaccaaacaaggacatcttcttctctataggattcggaaggacgttgtgccagcagatgtagcatcacctgaaagcggcagttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttga

SEQ ID NO: 198651 - DNA, 629 bp, Homo sapiens
  Payload ID: 19205
  Gene Name: vacuolar protein sorting 39 homolog (S. cerevisiae)
  ENST ID: ENST00000564994
  CDS Start-End: 1-144
ctccatgcagaattcctgagggtccaggaagagcggattttacaccagcaggtgaagtgcatcatcacagaggagaaggtgtgcatggtgtgtaagaagaagattgggaacagagaaggagaacatggctgctggctgtcctgacaacttttagttcttgagccttcagagagcagcctgttctatctgttgggagtgggcttcgagaatttaaagacctgcaatgtatgtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaa

SEQ ID NO: 198652 - DNA, 4100 bp, Homo sapiens
  Payload ID: 19206
  Gene Name: vacuolar protein sorting 4 homolog A (S. cerevisiae)
  Uniprot ID: Q9UN37
  ENST ID: ENST00000254950
  CDS Start-End: 157-1470
ggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagctacccaagtgatctcatctttccttgactcttaactgagactctgaagggccacccttgcttccaattaaaagaccctctggttttctgtctcctctcttttctaaagcagagcaggaaacagaacactgcagttcttaggcctgttctccagtcaggtgtgcaaggcctcctccccttaaggcctcagaagtttggctggggatgtttgtgggatccagacagttcttgccgttgttcggcctacagatcagagactgcaaagtgggagccctgcgtaccagacccgtcctgcagctgtgtttgtttggtttggtctgccgctaacatttaaaagtcgagagttgctgggcgcggtggctcacgcctgtaatcccagcactttgggccgctaacatttaaaagtcgagagttgctgggcgcggtggctcacgcctgtaatcccagcactttgggaggccgacgcgggcggatcacaaggtcaggaaatcgagaacatcctggctaacacagtgaaaccccgtctcactaaaaataaaaaaattagccgggcgtggtggtgggcgcctgcagtcccagctacttgggaggctgaggcaggagaatggcgtgaacccgggggacggagcttgcagtgagccgagatcgcgccactgcactccagcctgggcgacagagcaagactctgtctcaaaaaaaaaaaaaaagtcgagagttgacataaaaattcagaattctgacttctagaagattaaattaggtaatgttgggcctgcgtcctcatggggcagcctgtcagcggccactaagtagaggctgctctgtacagaaggggtcccccatccccactcatctgtgttgcctgcccagatagccccatggccatttcagtttgcgacccccaacagaccaaggacccagagctggcagccctggacccacgtccggcaggcagtgaagctgcagaggctgtcccacgtttaccccatgcatataaacagaccaaagtcaaagcacattcacacagaaagacctggcctagtaaatgaagcttatagcctgcaaagggctttgttccaaccttccctctccaaaacccagtactgctcctctacctttcaaacctggttgggccagaactgattacatggccaactcttggctcacactgggcttgcactgggccatttctttgctctggttcagagcctctgcagaagtgagctaactttggatcagtagctccaacacttggctccagtgctggcaggttacccctcaaccatagcagctgggatctttgtggcttgggggtgcttgtgtaagttcttggttatgtgccctcagccaccaggatatgaaccgtgtctgcagagcttcactttagtgagcttacaagtttttaaatttttacttctagttacatttacttgaatcagaacgttgtttcctcattcctactgcttaaacaccttgacaagtcctaggggttaacaaaggttagcatggctatggtccatccctgtgctctagttagagcgtgaagacacctgactttccagttgtctctctccatgaccagcaacaggaaccactgacgctgaactttggacagtggcctcagactctggctgccagcacacaacctgccatcatcgatgttaaacatgctgacatgtgcagaggagtttcctccctgaaatgctctgaaattcacttctctgcctggggattctgttataaaccttctgcctacattggctttcactgtggaagttgatttctaaaactctgatgagctcacaacgttgacatgtatatgcgttttttgtgagtgcttcctgctcaaagtgggagagattttactggaaatgcaataaagtttgcattttattgcta

SEQ ID NO: 198653 - DNA, 3324 bp, Homo sapiens
  Payload ID: 19207
  Gene Name: vacuolar protein sorting 4 homolog B (S. cerevisiae)
  Uniprot ID: O75351
  ENST ID: ENST00000238497
  CDS Start-End: 205-1539
attgcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggaatgacagtgatggggaaggagaatctgatgatcctgaaaaaaagaaactacagaatcaacttcaaggtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaaactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaaggggttggtgtagacaatgatggaattttggttctgggagctacaaatataccctgggttctggattctgccattaggcgaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtccctggagataaacttttggagccagttgtttccatgtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataacctattgactgtattctgtgtattattctttattttgggaccttctgtgtaaaagaaaatattacctaaattggttagatacaaagaaatcattaaaattattaatgtatatatgaaaa

SEQ ID NO: 198654 - DNA, 551 bp, Homo sapiens
  Payload ID: 19207
  Gene Name: vacuolar protein sorting 4 homolog B (S. cerevisiae)
  ENST ID: ENST00000591519
  CDS Start-End: 132-518
ggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggaatgacagtgatggggaaggagaatctgatgatcctgaaaaaaagaaactacagaatcaacttcaaggttgctttagatttcatttttaaatttactatcctattaaaaagactcaaagtgaa

SEQ ID NO: 198655 - DNA, 1252 bp, Homo sapiens
  Payload ID: 19207
  Gene Name: vacuolar protein sorting 4 homolog B (S. cerevisiae)
  ENST ID: ENST00000588059
  CDS Start-End: 205-540
attgcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaaactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtcc

SEQ ID NO: 198656 - DNA, 769 bp, Homo sapiens
  Payload ID: 19208
  Gene Name: vacuolar protein sorting 41 homolog (S. cerevisiae)
  ENST ID: ENST00000265745
  CDS Start-End: 18-647
gactctcccgtggcgccatggcggaagcagaggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgagtaagaaacctgaggcatggagagtagccaagaaaatgaaaagctatcttaataattgaaggactgcattgggaatgggtcttgaaaatatcatttgcctgttggccaaagggtgtgaagatttttgacatcatctcaaagcaaagaatcaccaatgtgccccgggatgatataagtcttc

SEQ ID NO: 198657 - DNA, 5903 bp, Homo sapiens
  Payload ID: 19208
  Gene Name: vacuolar protein sorting 41 homolog (S. cerevisiae)
  Uniprot ID: P49754
  ENST ID: ENST00000310301
  CDS Start-End: 56-2620
aagtgtgtggtttcctcttatttccgggtctgtcaggtgactctcccgtggcgccatggcggaagcagaggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattagccaggcgtggtggtacatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtaggtgggagtacaggcacgcaccaccatgcccagctaattttttgtactttggtagagatgaggtttcaccatgttgcccaagctggtctcgaactcctgagctcaggaatccgcccacctcggccttccgaagtgttaggattacaggcgtaagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtc

SEQ ID NO: 198658 - DNA, 3181 bp, Homo sapiens
  Payload ID: 19208
  Gene Name: vacuolar protein sorting 41 homolog (S. cerevisiae)
  Uniprot ID: P49754
  ENST ID: ENST00000395969
  CDS Start-End: 1-2490
atggcggaagcagaggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtagtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcatt

SEQ ID NO: 198659 - DNA, 711 bp, Homo sapiens
  Payload ID: 19208
  Gene Name: vacuolar protein sorting 41 homolog (S. cerevisiae)
  ENST ID: ENST00000448833
  CDS Start-End: 1-451
agaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagaataacccagtggagagaagtgttgtggcttccatcctgctcagtggaatgctggtgctgccattgcttagagctgaggttctcaagctctaggatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctc

SEQ ID NO: 198660 - DNA, 354 bp, Homo sapiens
  Payload ID: 19208
  Gene Name: vacuolar protein sorting 41 homolog (S. cerevisiae)
  ENST ID: ENST00000439468
  CDS Start-End: 1-330
ctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaagtaacaattactatttttcaggatgctggtaacttctatagaacttgaattaaaacatttccttaaaaattc

SEQ ID NO: 198661 - DNA, 465 bp, Homo sapiens
  Payload ID: 19208
  Gene Name: vacuolar protein sorting 41 homolog (S. cerevisiae)
  ENST ID: ENST00000457055
  CDS Start-End: 247-465
acatttgcttttgctaagggcacacttggctttttaggttgtgcctttcctctattctacttaagtcaagcactaagaaatctactgtaaattctggactttccaccatgttttcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagactttt

SEQ ID NO: 198662 - DNA, 532 bp, Homo sapiens
  Payload ID: 19208
  Gene Name: vacuolar protein sorting 41 homolog (S. cerevisiae)
  ENST ID: ENST00000418457
  CDS Start-End: 219-532
acttagtggcgtggagctgaactgaagagattaggatttgacgtctgacgtagtcactctgtagctccataatcaagggctgtccaagggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaaggtaagtgctgtgtg

SEQ ID NO: 198663 - DNA, 548 bp, Homo sapiens
  Payload ID: 19208
  Gene Name: vacuolar protein sorting 41 homolog (S. cerevisiae)
  ENST ID: ENST00000414632
  CDS Start-End: 18-548
gactctcccgtggcgccatggcggaagcagaggagcaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatg

SEQ ID NO: 198664 - DNA, 575 bp, Homo sapiens
  Payload ID: 19208
  Gene Name: vacuolar protein sorting 41 homolog (S. cerevisiae)
  ENST ID: ENST00000413141
  CDS Start-End: 108-575
aatttaactttcagttttaaaggctgcatgtggacagtaccatattggacaggaaacctaggctgcacacacttactaaattataatttgaggcagcttacaaccagatgccaaagaaattacaatcagagagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactg

SEQ ID NO: 198665 - DNA, 2224 bp, Homo sapiens
  Payload ID: 19209
  Gene Name: vacuolar protein sorting 45 homolog (S. cerevisiae)
  Uniprot ID: Q9NRW7
  ENST ID: ENST00000369128
  CDS Start-End: 241-1857
atgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcagactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagagatggggtttcactatgttcccctgcctggtttcgaactcctgggctcaagcgatccacccgcctcagcctcccaaagtgctgggattacagctttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaa

SEQ ID NO: 198666 - DNA, 2790 bp, Homo sapiens
  Payload ID: 19209
  Gene Name: vacuolar protein sorting 45 homolog (S. cerevisiae)
  Uniprot ID: Q9NRW7
  ENST ID: ENST00000369130
  CDS Start-End: 547-2259
actgtttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaagga

SEQ ID NO: 198667 - DNA, 977 bp, Homo sapiens
  Payload ID: 19209
  Gene Name: vacuolar protein sorting 45 homolog (S. cerevisiae)
  ENST ID: ENST00000419023
  CDS Start-End: 31-977
gggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgc

SEQ ID NO: 198668 - DNA, 2695 bp, Homo sapiens
  Payload ID: 19209
  Gene Name: vacuolar protein sorting 45 homolog (S. cerevisiae)
  Uniprot ID: Q9NRW7
  ENST ID: ENST00000535106
  CDS Start-End: 674-2290
gggaagacgaatctcgaccactgtttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagagatggggtttcactatgttcccctgcctggtttcgaactcctgggctcaagcgatccacccgcctcagcctcccaaagtgctgggattacagctttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaagg

SEQ ID NO: 198669 - DNA, 2064 bp, Homo sapiens
  Payload ID: 19209
  Gene Name: vacuolar protein sorting 45 homolog (S. cerevisiae)
  ENST ID: ENST00000611412
  CDS Start-End: 191-1534
atccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaagg

SEQ ID NO: 198670 - DNA, 966 bp, Homo sapiens
  Payload ID: 19209
  Gene Name: vacuolar protein sorting 45 homolog (S. cerevisiae)
  ENST ID: ENST00000462852
  CDS Start-End: 275-871
ccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcagactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagagtgccgggaatcagtaaagacttaagagaagtggtcctatctgctgaaaatgatgaattctatgctaataatatgtacctgaactttgctgagattggtagcaatataaaga

SEQ ID NO: 198671 - DNA, 2714 bp, Homo sapiens
  Payload ID: 19210
  Gene Name: vacuolar protein sorting 51 homolog (S. cerevisiae)
  Uniprot ID: Q9UID3
  ENST ID: ENST00000279281
  CDS Start-End: 93-2441
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacga

SEQ ID NO: 198672 - DNA, 534 bp, Homo sapiens
  Payload ID: 19210
  Gene Name: vacuolar protein sorting 51 homolog (S. cerevisiae)
  ENST ID: ENST00000526578
  CDS Start-End: 205-534
gtgtgtgcgcacggggagtgggggggtgcggggaggggggaagggaaccaggcccctgctatattgctcccccagatcatgcctccgactttttgtgaggttcaggagagcaggtgttcataagaggacgaacctcggccagggagtacgagcagctgaggcgtctgaggggatctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctat

SEQ ID NO: 198673 - DNA, 633 bp, Homo sapiens
  Payload ID: 19210
  Gene Name: vacuolar protein sorting 51 homolog (S. cerevisiae)
  ENST ID: ENST00000530673
  CDS Start-End: 1-300
gtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaagatgacggcgctaatattgtatccctcccttcttatctggccccggagactttctgcctcatcccagctacttccatcgtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggt

SEQ ID NO: 198674 - DNA, 600 bp, Homo sapiens
  Payload ID: 19210
  Gene Name: vacuolar protein sorting 51 homolog (S. cerevisiae)
  ENST ID: ENST00000533487
  CDS Start-End: 8-253
tggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgcttt

SEQ ID NO: 198675 - DNA, 837 bp, Homo sapiens
  Payload ID: 19210
  Gene Name: vacuolar protein sorting 51 homolog (S. cerevisiae)
  ENST ID: ENST00000530773
  CDS Start-End: 137-837
gaaggacctagggctgcagggggacgtttcacctgaaggactgcctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaagga

SEQ ID NO: 198676 - DNA, 1078 bp, Homo sapiens
  Payload ID: 19210
  Gene Name: vacuolar protein sorting 51 homolog (S. cerevisiae)
  ENST ID: ENST00000533827
  CDS Start-End: 1-217
cagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggtgaagcactagctcctagccgggcagggaatggtgttgctgggaatgcagatggctggacagtgccctcatggccagaccccagaccagctgcctgatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgt

SEQ ID NO: 198677 - DNA, 1027 bp, Homo sapiens
  Payload ID: 19210
  Gene Name: vacuolar protein sorting 51 homolog (S. cerevisiae)
  ENST ID: ENST00000529180
  CDS Start-End: 25-1027
cgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggtgggcgctgccgggcagggcctgcagtgggcctttcctggggctctggggctaacgtcaccctccgtcccccaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtg

SEQ ID NO: 198678 - DNA, 691 bp, Homo sapiens
  Payload ID: 19210
  Gene Name: vacuolar protein sorting 51 homolog (S. cerevisiae)
  ENST ID: ENST00000526856
  CDS Start-End: 1-599
agacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtccgacttccaacgtgactcagacttccagggatcccggggagggttggctggagcagccccacacctgcccaaggagccccaggactctgtgaccaactgggggtgac

SEQ ID NO: 198679 - DNA, 854 bp, Homo sapiens
  Payload ID: 19210
  Gene Name: vacuolar protein sorting 51 homolog (S. cerevisiae)
  ENST ID: ENST00000534557
  CDS Start-End: 90-854
cgcggggctgggcttaggccgagccccaggatttcaaatgctgacaaacaccaaacacgctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcc

SEQ ID NO: 198680 - DNA, 723 bp, Homo sapiens
  Payload ID: 19210
  Gene Name: vacuolar protein sorting 51 homolog (S. cerevisiae)
  ENST ID: ENST00000528588
  CDS Start-End: 228-723
atgcatgtctcaagtttcccaaaacggaggcagtgtgaacacagtctacagatgaagaactggggctcagaaaagttgaggggcgtggtctagatttacagcaagtcttaggcagatgagagatgaggacccagctgcatagctggaaggcattcccagtcccagctactcaggaggctgagatgggaggattgctggaccccaggagtcccaggctgcagtgaactatgatcatgccactgtactccaagctgggtgacagagaaaaaaagaaaagaaaagaaaaagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgaga

SEQ ID NO: 198681 - DNA, 1089 bp, Homo sapiens
  Payload ID: 19210
  Gene Name: vacuolar protein sorting 51 homolog (S. cerevisiae)
  ENST ID: ENST00000534124
  CDS Start-End: 25-516
cgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacaggcagtgcgctggacacgcagatgcgcttgggagccagcggtccctgccttggctgcttgtggtctgatggagcagttgaggcacagtggtggcagctggctaagcacctgcggcctgcttcggatctggactaattctgagggccggctctcctgggcaccagggttagggggttacggggagtatacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccc

SEQ ID NO: 198682 - DNA, 2960 bp, Homo sapiens
  Payload ID: 19211
  Gene Name: vacuolar protein sorting 52 homolog (S. cerevisiae)
  Uniprot ID: Q8N1B4
  ENST ID: ENST00000383210
  CDS Start-End: 220-2391
agcgaaggttccggggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcagagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 198683 - DNA, 2960 bp, Homo sapiens
  Payload ID: 19211
  Gene Name: vacuolar protein sorting 52 homolog (S. cerevisiae)
  Uniprot ID: Q8N1B4
  ENST ID: ENST00000441058
  CDS Start-End: 220-2391
agcgaaggttccggggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 198684 - DNA, 2960 bp, Homo sapiens; identical to SEQ ID NO: 198683
  Payload ID: 19211
  Gene Name: vacuolar protein sorting 52 homolog (S. cerevisiae)
  Uniprot ID: Q8N1B4
  ENST ID: ENST00000448042
  CDS Start-End: 220-2391

SEQ ID NO: 198685 - DNA, 947 bp, Homo sapiens
  Payload ID: 19211
  Gene Name: vacuolar protein sorting 52 homolog (S. cerevisiae)
  ENST ID: ENST00000421357
  CDS Start-End: 1-378
gaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 198686 - DNA, 2960 bp, Homo sapiens
  Payload ID: 19211
  Gene Name: vacuolar protein sorting 52 homolog (S. cerevisiae)
  Uniprot ID: Q8N1B4
  ENST ID: ENST00000443860
  CDS Start-End: 220-2391
agcgaaggttccggggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 198687 - DNA, 2960 bp, Homo sapiens; identical to SEQ ID NO: 198686
  Payload ID: 19211
  Gene Name: vacuolar protein sorting 52 homolog (S. cerevisiae)
  Uniprot ID: Q8N1B4
  ENST ID: ENST00000428608
  CDS Start-End: 220-2391

SEQ ID NO: 198688 - DNA, 2960 bp, Homo sapiens; identical to SEQ ID NO: 198683
  Payload ID: 19211
  Gene Name: vacuolar protein sorting 52 homolog (S. cerevisiae)
  Uniprot ID: Q8N1B4
  ENST ID: ENST00000445902
  CDS Start-End: 220-2391

SEQ ID NO: 198689 - DNA, 3331 bp, Homo sapiens
  Payload ID: 19211
  Gene Name: vacuolar protein sorting 52 homolog (S. cerevisiae)
  ENST ID: ENST00000476725
  CDS Start-End: 202-468
agtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggtgagagcgcggagctgtttctcctccgtagttccggtgctcctagcttcagaaagacctgagctgggtttaggcacaagggtgggaacttggctgctacccgtgatattacctgtttggctccccgtacccttccctgtgatcagacccgaccctgagcgggaccctagtggctgaaactcatgttctggggcacaaaatttcaacttcactccacattttggggtagagtcacgaagtagtatagtgtaaaggttaagaacatggcctctgaagccagactgcctgagttctatctctgccacttacacgctgtgtgcccttgggcaagttaaccagcttctctgtgccatcatttctcacacctttaaggtgaggaagatagaacctattgtatacatcgtcgttaggattagatgaatatgtgtaagattgcacctggcatgcaggcgggtggtcctgggctccaggaaccactgcaacttggggagttggatatcacttctgatgaattcatcctggatgaagtggatgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatg

SEQ ID NO: 198690 - DNA, 3338 bp, Homo sapiens
  Payload ID: 19211
  Gene Name: vacuolar protein sorting 52 homolog (S. cerevisiae)
  ENST ID: ENST00000478392
  CDS Start-End: 202-468
agtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggtgagagcgcggagctgtttctcctccgtagttccggtgctcctagcttcagaaagacctgagctgggtttaggcacaagggtgggaacttggctgctacccgtgatattacctgtttggctccccgtacccttccctgtgatcagacccgaccctgagcgggaccctagtggctgaaactcatgttctggggcacaaaatttcaacttcactccacattttggggtagagtcacgaagtagtatagtgtaaaggttaagaacatggcctctgaagccagactgcctgagttctatctctgccacttacacgctgtgtgcccttgggcaagttaaccagcttctctgtgccatcatttctcacacctttaaggtgaggaagatagaacctattgtatacatcgtcgttaggattagatgaatatgtgtaagattgcacctggcatgcaggcgggtggtcctgggctccaggaaccactgcaacttggggagttggatatcacttctgatgaattcatcctggatgaagtggatgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 198691 - DNA, 3338 bp, Homo sapiens
  Payload ID: 19211
  Gene Name: vacuolar protein sorting 52 homolog (S. cerevisiae)
  ENST ID: ENST00000497240
  CDS Start-End: 202-468
agtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggtgagagcgcggagctgtttctcctccgtagttccggtgctcctagcttcagaaagacctgagctgggtttaggcacaagggtgggaacttggctgctacccgtgatattacctgtttggctccccgtacccttccctgtgatcagacccgaccctgagcgggaccctagtggctgaaactcatgttctggggcacaaaatttcaacttcactccacattttggggtagagtcacgaagtagtatagtgtaaaggttaagaacatggcctctgaagccagactgcctgagttctatctctgccacttacacgctgtgtgcccttgggcaagttaaccagcttctctgtgccatcatttctcacacctttaaggtgaggaagatagaacctattgtatacaacgtcgttaggattagatgaatatgtgtaagattgcacctggcatgcaggcgggtggtcctgggctccaggaaccactgcaacttggggagttggatatcacttctgatgaattcatcctggatgaagtggatgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcagagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 198692 - DNA, 947 bp, Homo sapiens; identical to SEQ ID NO: 198685
  Payload ID: 19211
  Gene Name: vacuolar protein sorting 52 homolog (S. cerevisiae)
  ENST ID: ENST00000462479
  CDS Start-End: 1-378

SEQ ID NO: 198693 - DNA, 3338 bp, Homo sapiens
  Payload ID: 19211
  Gene Name: vacuolar protein sorting 52 homolog (S. cerevisiae)
  ENST ID: ENST00000461476
  CDS Start-End: 202-468
agtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggtgagagcgcggagctgtttctcctccgtagttccggtgctcctagcttcagaaagacctgagctgggtttaggcacaagggtgggaacttggctgctacccgtgatattacctgtttggctccccgtacccttccctgtgatcagacccgaccctgagcgggaccctagtggctgaaactcatgttctggggcacaaaatttcaacttcactccacattttggggtagagtcacgaagtagtatagtgtaaaggttaagaacatggcctctgaagccagactgcctgagttctatctctgccacttacacgctgtgtgcccttgggcaagttaaccagcttctctgtgccatcatttctcacacctttaaggtgaggaagatagaacctattgtatacatcgtcgttaggattagatgaatatgtgtaagattgcacctggcatgcaggcgggtggtcctgggctccaggaaccactgcaacttggggagttggatatcacttctgatgaattcatcctggatgaagtggatgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 198694 - DNA, 3338 bp, Homo sapiens; identical to SEQ ID NO: 198693
  Payload ID: 19211
  Gene Name: vacuolar protein sorting 52 homolog (S. cerevisiae)
  ENST ID: ENST00000482399
  CDS Start-End: 202-468

SEQ ID NO: 198695 - DNA, 2656 bp, Homo sapiens
  Payload ID: 19212
  Gene Name: vacuolar protein sorting 53 homolog (S. cerevisiae)
  Uniprot ID: Q5VIR6
  ENST ID: ENST00000291074
  CDS Start-End: 135-2147
ggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcacccggaaggtttcttaattcgttcttccatttatttttaaaaattttgtttgaacgcctactaagttctgggtgcagggtataacacagcaagcaccatggaaaggtccctgctcctagtgctcacactccaataagaagaagtggctgggccgggcacagcggctcacgctgtaaccccagcatttcgggaggcctgggcaggcagatcacctggggtaaggaatttgagagcagcctggccaacatggtgaaatcccatctctactaaaaatacaaaaattagctgggcatgggggcaggctactggggaggctgaggcaggagaatcacttgaacccgggaggtggaggttgcagtgagccgatatcacaccactgcactccagcct

SEQ ID NO: 198696 - DNA, 1903 bp, Homo sapiens
  Payload ID: 19212
  Gene Name: vacuolar protein sorting 53 homolog (S. cerevisiae)
  ENST ID: ENST00000389040
  CDS Start-End: 1-1644
atgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaaggttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatcgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtag

SEQ ID NO: 198697 - DNA, 1269 bp, Homo sapiens
  Payload ID: 19212
  Gene Name: vacuolar protein sorting 53 homolog (S. cerevisiae)
  ENST ID: ENST00000401468
  CDS Start-End: 1-1269
atgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaaaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtag

SEQ ID NO: 198698 - DNA, 13106 bp, Homo sapiens
  Payload ID: 19212
  Gene Name: vacuolar protein sorting 53 homolog (S. cerevisiae)
  Uniprot ID: Q5VIR6
  ENST ID: ENST00000437048
  CDS Start-End: 148-2646
gaagtgccggagcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacagctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagcagcaaggggccctttgctcctggctggagaccctcagcgcccgttccccagaagcccccaacctctcctgtgctccccggcactctcacatcgtcggtcttcaaacttcctgggacatgtgggttgttactgagtctctcccatgccctgtcttacttcctgccctaatcggagacgctgagtaagggctgggctctaagagggcgatttaggtgatctctggttcgtgaagcagaggcagcagtggaggataggtccctgagctgcccttgactcatgtagcctccccatggcagtcacaccctcttgacacgtgggccccacccgtcctttttttttttttttttttttttttttgagacagagtctcgctctgtcacccaggctggagtgcagtggcgtgatctcggctcactgcaacctccgcctcccaggttcaagcaattctcctgcctcagcctcctgagtatcggattacaggcgtgagccaccgagcccagccccttcctccatttctttactcccaccctgctcctggtttctagggaagggaaaccaggaagttcacttggaagacgtttcctaggttttctcatcagatgaagccatgggaacgcccaggaagtccatactctcaaacccctttctgcccactcaccttcaggtccacagcactttccagcgtcatctgaaatagcaaaggtgatgtgcagcatcccagtgatgtgttcctgtgttatgagaaggagtctggggttctggatgcctcaggaacagaatatggaccttaaagaccaggctgagagcctggcctggcacgcagcctgcccgccccccccgcccttcctgtccaccgcgggctctctgcagcagggcttgccgaagagactgctcccgacctctcatgtcatcctgcatccagagaatggcagcatatcaagccgttaaccctgattcactcggttcccttgaaaccaggcctcagttaaccatgaccacagctacaggcaaaccgctgctgttgctgcctgcttttgctgaagaatgatatcttgccaggcacggcggctcatgcctgtagtcgcaacactttgggagaccaaggcaggaggatcacttgagtccaggagtttgagaccagcctgggcaacatacagatgtctacaaaaataaaaatttgcaaggtgtggtggcatgcacctgtagtcccaactgctagggaggctgaggtgggcagattgcttgagctcaggagtttgagaccagtctgggcaacctggcaaaaccaaaaatacaaaaaattggctgggtgtggtggctcatgcctgtaatcacagcactttgggaggctgaggcaggtggatcacctgaggtcaggaattcgagaccagcctgcccaacatggcgaaaccctgtctcaactaaaaataaaaaaaattagccgggtgtcatggcgagtgcctgtaatcccagctactggggaggctgaggcaggagaatcacttaaacccgggaggtggaggctgcagtgagccaagatttcaccactgcactccagcctgggtgacagagcaagaccccttctcaaaaagttttcaggatagaggaaatttccttaaaatccataaaacttgtaacagccgtacagtaggaataaggtttggaaatctgcctggaaacctgatttcctcatccccaccttgtttcccaacataaccactgctctgtgcccctgccctctctgccaggctttctccccgatgccgtccagctctgatcctgagtgtcatttcttcatcggcttccaggctgtccttgctagctggtttgactctcacgcatcaagcgtctcaaatttgagaatgcggaggagaaaagaagtgttgcgagaaggagatgcggccttcagttgaggtctattaggaaaagattccaaataagacaagggcggggggcggcagtcgggagagcccccaggaagccctgtagatgcccccaccccagcccatggagttgctatggttaagcagcctgagccgtacagttgaaaaggggcggtggggcccatctccaaatagcacagccagttcagccgtctgtcctcaacccaggagagctgggaaagccagtggactcctgcacctggttcttgtcactcctggcgtttgtgtacagatcaccacttctctttttggttcattgttgaggagtcgttttccggacggctccatcacagcattgagctatcaagctgctgttttccacagttggtggtcacagccagggaagttgctgtcttgatttgttacattgtcagtaatccccaaggaaccaatggatgtcagtaggagtttctgttaaatgtctccttgatggggactcagtactgtgtagagacgctgtgtttctcttctgggggtgtgcatcagaaccactggggccttttaaaatctacagatgccggccgggcgccgtggctcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctttatttattaacatcacttcaaaaataacgtatcaaaggggcaccctaggccgggtactgtggcatcacacctgtaatgccagtgctttgagaggctgaggtgggaagattgcttgagcccaggacttcaagacaagcctgggcaacagagtgagaccccatctctattaaaaaataggccgggcatggtggctcacactggtaatcccagcactttgggaggccgaggcaggtggatcatgtgaggtcaggagttcgagaccagcctggccgacatggtgaaaccctgtctttactaaaaatacaaaattagccaggcgtggtggtgggcgcctgtaatcccagctactcaggaggctgaagcaggaggatcgcttgaacccaggaggcagaggctgcagtgagccgagatcatgccattgcactcctgcctgggtgacggagcaagactctctaaaaaataataaggtaaaaggagtacctgtggatgaaagcagcagctaacagctctgtgattcagctagacctagatattgtgcccattccttcccctcagtccattttctgtagcccctttaaaaaccaaaaaacaactttgaagtcactttgggtttaaaataaatagtggtaatttgtataatcaataaagagttcactctgctcttactgaggggacttgtctgaaagctggcttagcggtgtccaggccagagaacatcctgtgtggactcttaacaatgaaacaggagccgcaatggacaaggtgttctgatctccaaacccagctcagggattgaagctaactaccgccactccttcctctctcgaagaacaaagagccagtacccagggctctgcccacccccgagaaggggtgcctgatttcttatgtctagggtggctcctctgtgcagatcagacaggactgagagcagacaagctgagaccagcatgaccagtacagggcacgcagagcgtgggggcaggtccgaggctgctgctcgatgcagggtatgacaccaacccttcctgaattgccatcggatgaggagacctggttccctgttgaaagaatgccaggggaaatgctgcatgtgcacagctggaaatggggttccttctctaggaagagcactcggaataacctgctggaaatggggttccttccctaggaagagcactcagaataacctgctggaaatgggattccttggctaggaagagcactcagaataacctgctggaaatgggattccttggctaggaagagcactcagaataacctgctggaaatgggattccttacctaggaagagcactcggaataacctgctggaaatgggattccttacctaggaagagcactcggaataacctgctggaaatggggttccttccctaggaagagcactcggaataacctgctggaaatggggttccttccctaggaagagcactcggaataacctgctggaaatggggttccttcgctaggaagagcactcggaataacctgctggaaatgggattccttcgctaggaagagcactcggaataacctgctggaaatgggattccttcgctaggaagagcactcggaataacctgctggaaatgagattccttccctaggaagagcactcggaataacctgctggaaatgggattccttcgctaggaagagcactcggaataacctgctggaaatgagattccttcgctaggaagagcactcggaataacctgctggaaatgggattccttcgctaggaagagcactcggaataacctgctggaaatgagattccttcgctaggaagagcactcggaataacctgctggaaatgggattccttcgctaggaagagcactcggaataacctgctggaaatgggattccttcgctaggaagagcactcggaataacctgctggaaatgggattccttccctaggaagagcactcggaataacctgctggaaatgagattccttccctaggaagagcactcggaataacctgctggaaatgggattccttcgctaggaagagcactcggaataacctgctggaaatgggattccttcgctaggaagagcactcagaacaacctgcctgcttgagggtgacagcaagtgtctcacacttctcgtctactccaagtcagattcctaaaaataaaatagagctccaatgggcaatttaagcaaaagccttagaaacatggacacctgaaatgctggcctacatgaagggtacgatgacattttatatattaaataaaaattcccagtcctgttttagtattcatcagaatagcctcttggaccctcgaagttctacacctttgggagatataaatttccttaaaataaagggattgcttctttgtgtaaatagctttcattttctccatctggaagtgatttctgcctgcatgttggagcacaaaatactgcagttaattaaagcattactggatgtcatttgctagaatgtatttccttactgctgacagaaaacagaacagactctaggaaagaagtagcaagtccgtgaccctggccgctcctggtggctgcccttctcccttccctgacagtctaaggaagcaacgcgtgggagcagaatgtggccgactgagcccagtcctgacctgcccagttgcagtggagcctgtctgtaatgttgtgtaaagtgttttgcttctgacttggaaccctacttgccctgtgaatttctatcctgtgaaccttcccttctctgtccttaccgttcccatcacagcctgctcttccagtgacggccaagtgatttctctcctgcacgcatgagtccatcctgtttccttagtagctggatggacgttttgccatgaaaactctttgggaagtcttgtgtcctttagtgatttctctcctgcacgcatgagtccatcctgtttccttagtagctggttggacgtttttgccatgaaaactcttcgggaagtcctgtgtcctttcaacaggggaaaactggctgcggcccttccattaggctccaggatcattacctcgtttccattctttcttttcaacagctccccactttactagggaagccaagggatcaacctaatgagaaaagaaccttccctgtagcccacctggaagggcattgcctgccagctccttccttctcacctatgtgaacaggagggaagatgccggcgatccatggatctgtgggacatgaaggacgtgtccatcagaaatgaaagcagcctgggattggaagcatccacagaagacttgatctgcaggtcttgatttggacctggcactttgacaccaggcgagtcactgatcccctgagcatccattttcaatattggtgagaggggattataatgaatattggctgtgaaggtcacacaagaccgggctatatgcacttgctctgccataaggcagtgtgaagtgtgttcgtgatcacttgtgggcgggagcctgtggctgtcttgcctggactggcttttttaaacatggatgagtggtgacaaatcctgcggccgtgtgcaggctacatccgcagcgagctccgcatatctggtctttgcctttttaggtcatgactgtaatatcaagcttacacgagagttttaaaagactgagcagtatccccttcccctggcagctgctgcttccgtagcatttagggataaacctgcagacactgagaagagagcttcctccctcctggggctggtggcgaggctgcctgttgtggaaaatagggcatgtctcctgtgaatgcgaattgcgagggttgccaaagcctcccttccaagaaacttgcttaggtgtctggtgtccacagaccagactcttctcccgacagggacaaaaattcttgcctgcctttctttttcttttttttccttttacttattcttgccttttttcttcttcttcttctttaggtatgatgccccccaaaaaactaagcaagattaacttgggacaggcagttctaactgggaagcctgagctcacaggctgtttggattactttccaattgtgtttcaaagatgtttagacttttcccaaggccagctgaatccttataatcagcccaaaagttcctttctgtttctgtctgtcccctttgagggtgttgactcagagaacctggggcaatatgagatgttaaaataaaaatagcgtccaacgtcccgcctcctgggaatgctgctcacttcatccgagggttctgggagcttctgctcagtcatcaaatggaatttgcacaattgtcttgcctcctgttttgggtaatttttcaacaagtgagaaattaagaacagcttctcaacaaacttccctctacttccagggccaagaaaagtatttgcagtgtgggctgcagctttcaggggtctcaggtgaaatggtggcaagaaaccccagctcccttcatgtgtttgccttgcgctgatggaaaaggaaggcacttctcagctgccagagaccacattccacagggttcttcacaaaatcaagcactgcagtggaccaactggagcagccactggagggctttagaaggcaaatggaatacatatcaaatgctatataaagaaaacatctgtttacacagagtcccccacagcctcatacctacacccaatatcaaatgctgtataaagaaacatcagtttacacacagagccccccacaacctcatacccacaccgaatatcaaatgctatacaaagaaacatcagtttacacacagagtcccccacagcctcatacccatgcctgtcacatctttgcacagccctaaaggatccagagctttggatcagcagctggctagctcggaggccagaggagggtgctgaggggagtggaggtcagttggggtagccctgggccctggctgcacagtccagctgctgtgtggcctgcatgtggtatcttaggtcatgagagggcctgggcaattcagtgctatctgtacatgttggtggggtgggaaggaaaaggtaactgtgtatttactgtgtcctggatacattatctcatcggatgaaattcctgctaagttaagctccgtttagtggacgggacttggaggctcaaagagggtaagtgacaggcccaaggatatgtgcctagtgaggggtgagccaggattcgatgtgtgactagtaaggggtcagccaggattcaatatgtgactagtaaggggtcagccaggatttcatatgggactagtaaggggtcggccaggatttgatacgtgactagcaaggggacaagccaggatttgatatgtgactagtgaggggcgagccaggattcgatatgtgactagtaaggggtcagccaagatttgatatgtgactagtgaggggcgagacaggatttgatatgtgactagtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggtggagccagtcaggatttgatatgtggttagtgaggggttagccagtcaggatttgatatgtggctagtgaggggcgagccaggatttgatatgtgactagtaagggggtgagccaggattcaatacgtgacaagtgaggggtgagccaggattcaatacgtgaccagtgaggggcgagccaggattcgatacgtgaccagtgaggggcgagccaggatgcgatacgtgaccagtgaggggcgagccaggattccatacgtgactagtgaggggtgagccaggattcgatatgtgagtagtgaggagtgagccaggatttgatatgtggctactgaggggcgagccaggatttgatatgtgactagtaaggggtcagccaggatttgatacgtgactagtcagggggtcagccaggattcgatacgtgactagtaaggggtcagccaggatttgatatgtgactagtgaggggtgagccaggatttgacatgtgactagtgaggggtgagccaggattcaatatgtgactagtgaggggtgagccaggattcgatatgtacctagtgaggggtcagccaggatttgatatgtggctagtaaggggtgagccagccaggatttgatatgtgactagtgacgagtgagccaggatttgatatgtgactagtaagggggtgaggcaggatttgatatgtgactagtaagggggtgaggcaggatttgatatgtgactggtgaggggtgagacaggatttgatatgtgactagtgaggggtgagccaggatttgctatgtgactagtaagggggcgagccaggatttggctccagccttcattccaacatccatgccttttgtacttcaccagcagttttcaaatttatgggacaaaattttacattggattccctctatacaaaatagataaaagtattttatgaatacattttatgagttcaaatatttttcagaagaaatcagtaaaagcattgaaaactattccagcaaataggaagcactttaaaccaaggttatggatgaaaatgtgtgtgtatcaaccccagtttacttctgggttgcacagaatagagaaatcttgatttaatccagctaagaattttcaaatagtatccattttgttttgttttaaacagctcttcttgcaatggtagaggctcttcaattaaacagagatggtaacaggc

SEQ ID NO: 198699 - DNA, 3204 bp, Homo sapiens
  Payload ID: 19212
  Gene Name: vacuolar protein sorting 53 homolog (S. cerevisiae)
  ENST ID: ENST00000573028
  CDS Start-End: 148-798
gaagtgccggagcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaaggaaacccaaaacactgcagctgcatggattgaactggacgtgatgtgaaatgaaataagccagacacgggaagacagattcctcatgttctcactcatagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcacccggaaggtttcttaattcgttcttccatttatttttaaaaattttgtttgaacgcctactaagttctgggtgcagggtataacacagcaagcaccatggaaaggtccctgctcctagtgctcacactccaataagaagaagtggctgggccgggcacagcggctcacgctgtaaccccagcatttcgggaggcctgggcaggcagatcacctggggtaaggaatttgagagcagcctggccaacatggtgaaatcccatctctactaaaaatacaaaaattagctgggcatgggggcaggctactggggaggctgaggcaggagaatcacttgaacccgggaggtggaggttgcagtgagccgatatcacaccactgcactccagcctgggtgacaaagtgagactccatctcaaaaaaacaaacaaacaaaaaaactagcaaaaaacttggaatattggccgggcatggtggctcacgtctgtaatcctagcactttgggaggcccaggcaggcggatcatctgaggtcaggagttcgagaccagcctggctaacatggtgaaccctgtctctactaataatacaaaaaattagccgggcgtgatggtgggcgcctgtaatcccagctactcgggaggctgaggcagaattgcttcaacccaggaggtggaggttgcagtgagctgagatcacaccactgtactccagcctgggcaacaagagcgaaactccatctc

SEQ ID NO: 198700 - DNA, 729 bp, Homo sapiens
  Payload ID: 19212
  Gene Name: vacuolar protein sorting 53 homolog (S. cerevisiae)
  ENST ID: ENST00000570650
  CDS Start-End: 1-714
agaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaacaccaccaaaagggaggctggctgggaggaccagctctgagaaacctgtaaccatgtactttgcagctagccctgcattcattctttcccagcaccacaagggcaggagccaagagagcagagcttccaggagcagttctgaaatgatgcaatcaaatgtgtctggtcccttgattaaatgattgtaatagaatgga

SEQ ID NO: 198701 - DNA, 585 bp, Homo sapiens
  Payload ID: 19212
  Gene Name: vacuolar protein sorting 53 homolog (S. cerevisiae)
  ENST ID: ENST00000574029
  CDS Start-End: 122-559
gctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaggcaggagaatcacttaaacccgggaggtggaggctgcagtgagccaagatttcaccactgcactccagcctgggtgacagagcaagaccccttctcaaaaagttttcaggatagaggaaatttccttaaaatccataaaacttgtaacagccgtacagtaggaataaggtttggaaatctgcctggaaacctgatttcctcatccccaccttgtttcccaacataaccactgctctgtgcccctgccctctc

SEQ ID NO: 198702 - DNA, 2356 bp, Homo sapiens
  Payload ID: 19212
  Gene Name: vacuolar protein sorting 53 homolog (S. cerevisiae)
  Uniprot ID: Q5VIR6
  ENST ID: ENST00000571805
  CDS Start-End: 138-2237
agcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactca

SEQ ID NO: 198703 - DNA, 613 bp, Homo sapiens
  Payload ID: 19212
  Gene Name: vacuolar protein sorting 53 homolog (S. cerevisiae)
  ENST ID: ENST00000576019
  CDS Start-End: 410-613
gaaacagtccataaagaagcaccaagagaacattttgagctgatttcaaggggaaattataccctattcctccactacaagttggcctgggaccttgtgccacccagagtgacgataggatctaaaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtat

SEQ ID NO: 198704 - DNA, 3463 bp, Homo sapiens
  Payload ID: 19213
  Gene Name: vacuolar protein sorting 54 homolog (S. cerevisiae)
  Uniprot ID: Q9P1Q0
  ENST ID: ENST00000272322
  CDS Start-End: 156-3089
gggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacaggtgattcacatagtttatatgttgccccatctctagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggaagatgactgtcaagttttagaagaggaaagactaatatctcttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaa

SEQ ID NO: 198705 - DNA, 3594 bp, Homo sapiens
  Payload ID: 19213
  Gene Name: vacuolar protein sorting 54 homolog (S. cerevisiae)
  Uniprot ID: Q9P1Q0
  ENST ID: ENST00000354504
  CDS Start-End: 591-3065
tcagttcctgggtggggccaacaagatcaaatgaggcagtttattgatctgggtggtaccagctgatccgtcgagtacagggtctgcaaaatatctcaagcatggatcttaggagcagtttagggggagggtcagaatcttgtagtctccagttgcatgactcgactcctaaaccgtaatttctaatcttgtggctaatttgttagtccaacaaaggtagtctagcccccaggcaagaaggtggtttgttttgggaaaggactgttatcatctttgttttaaactataagctaagttcctcccaaagttagttcaccctatgcccaagaatggacaagaacagcttggaggttagaagcaagatggagttggttaggtcagatctctttcactgtctcagttataattttgcaatggggatttcagctacttgggaggctgaggcatgagaatcacttggacccaggaggtggaggttgcagtgaaccaagatcacgccactgcactacagattgggtgacagagtgagactctgtctcaaaaaagaaaaaaaaaatctacaaaaactctgtagctaatggggaaactagatgcttcccactaagaacaggatcaagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggaagatgactgtcaagttttagaagagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaattcatatggtgtcccaccttatttaatgatggtacaatttaaaatcttagtcaacttctgtagaaagttttctctatgaaagtaaagctgtttgaaaaattattatttttttacagatctttctataaaaaataaacatcttttgattgcttgga

SEQ ID NO: 198706 - DNA, 4337 bp, Homo sapiens
  Payload ID: 19213
  Gene Name: vacuolar protein sorting 54 homolog (S. cerevisiae)
  Uniprot ID: Q9P1Q0
  ENST ID: ENST00000409558
  CDS Start-End: 156-3053
gggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggaagatgactgtcaagttttagaagaggaaagactaatatctcttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaattcatatggtgtcccaccttatttaatgatggtacaatttaaaatcttagtcaacttctgtagaaagttttctctatgaaagtaaagctgtttgaaaaattattatttttttacagatctttctataaaaaataaacatcttttgattgcttggatttaggaattcaatttttgtttcagtgaccaatgtcaagttgcaggctttgtgtgttgcatatttaatatttctactaccaccgtatgtcaactgggtaaagccttccagagctctctaaatacctgaaagacttaagcctttttttaagtaattaatacttaaaaaaaaagatcctggcatctatttatgcaactaaatacttttcagaaatggtatataaaaggctacagtttaatatctgtatttttataaaagtatgatgaagggtttggggtgtttttatttgtagcagaggtaagaatatgtattcatataatctgcctacttttgagttctcatattaacatttagataacatatgaagtatggcccccttggatccttgtttttaagttactttcgatgtgtatacgaacaaagaccagggagaaacagaacttttaaaactataggctgctgtgttggggccagaaataaggtgacaagtaaagacttttataatacctaccttcaaaattagaatcagcagcactgtacaaataaagtgcctgtgcttcacctcacaccaagaatcttgcctaaccctgtcagagtgcctaatatcctgtggtgattatgtataatgaaacagtcttattttgtgctctttggtttcttaaaaggaaagcttgttttctttcctttatcattacagaggtatgtctttggttcttaaactatctgtctaaaataaagctgtaaaaaattaacaga

SEQ ID NO: 198707 - DNA, 1277 bp, Homo sapiens
  Payload ID: 19213
  Gene Name: vacuolar protein sorting 54 homolog (S. cerevisiae)
  ENST ID: ENST00000416400
  CDS Start-End: 1-245
attctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaaggtgctgaacatgactgaggccacttaggtcaaaaaacctggactggcttcaaatgtgcatggaaggaattcactgaactttacaaaattcatctcactaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttc

SEQ ID NO: 198708 - DNA, 1347 bp, Homo sapiens
  Payload ID: 19214
  Gene Name: vacuolar protein sorting 72 homolog (S. cerevisiae)
  Uniprot ID: Q15906
  ENST ID: ENST00000354473
  CDS Start-End: 38-1165
aggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggctctttgtgtttttccttgtcttttgtcctcagacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatccc

SEQ ID NO: 198709 - DNA, 1527 bp, Homo sapiens
  Payload ID: 19214
  Gene Name: vacuolar protein sorting 72 homolog (S. cerevisiae)
  Uniprot ID: Q15906
  ENST ID: ENST00000368892
  CDS Start-End: 93-1187
gtggccacccgcaggtagtgatgtcgagcgtcgagctcccaaaaccgagctggtgaggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttttgtctggtgtccagtctagggttgggagcaagaagtatttgaatacctgcatatatttgggtctttattcgatagcatttattatgagctgtcctttctaaattgtattcattcctccaactaaattataaacatctgaaaattgcacaccaaaa

SEQ ID NO: 198710 - DNA, 5047 bp, Homo sapiens
  Payload ID: 19215
  Gene Name: vacuolar protein sorting 8 homolog (S. cerevisiae)
  ENST ID: ENST00000287546
  CDS Start-End: 172-4458
aggtagtgcgcgtgcgtgaggctagagcagtgggtgcggtcacgtgggccggcggtccacggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttggtaaatatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttctgcaggtctc

SEQ ID NO: 198711 - DNA, 2359 bp, Homo sapiens
  Payload ID: 19215
  Gene Name: vacuolar protein sorting 8 homolog (S. cerevisiae)
  ENST ID: ENST00000424463
  CDS Start-End: 89-583
agataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgtaagtatactttaactttttaaaggtaagttttctatttgattgggttttcttagatttatcattacattgttcaaaatactacataagttgttatggtaataaattcacaagtcattttactgccagtaatcaggtttaacatttatccatgttgaatgctttcttttttcctaattttttgttactttttaggcttttgtttgagaagcagataatggagtaatattagccttctccaggtttatttgtttgtagtactaccctgcccaagtaaatttgcttcttctgtgatttggctccccttccacaaggaatggaaagcatcatttgataggatcactttgtggaaaatagtacatttaacagctctggattccattgtcaggcttgccaaatagaactctgttgcagtattgtagagaactaggggatattgaaagcacgctggtactctctcttcttgtcttcctccagtgcctttttagcattccttttagtcagtctttggtaaggaagtgggtgagttttgaacactttggatggctttaggcccctgcggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctggatgaaattcttcttatttacaatagtttgtatgtcatctggtgcctagaggaaggcaggccaacaaattcaactctgattatttcaagattcttaatgtaatgtcttaaaacgtaatcttcccttttgttttcaggcagtatccagtctgatagcagtgggtacatctcatggattggctttaatatttggtaaatttttaagtgctttcctgcttttaaatattaagtgtccttttgggttttataatgtcctttaatcacagtttatatagtgtacttgattttcttgaacaaaaccagaaaaacttgaaaagtagcagtcagtatttttatagctaaaaattatttgcctcacagctttgttttgctgcttattgcaagtttattttcttcttcatgaatttataagctatcatatctattgatctctctgcaaacctagacaaaaagaataaagttgaagggaaccttgggttatcatcttgtctgcctccggttgttggtggtggggatttttgattctgaatcaccttccagtaatgggtattctaaaagatcttcaggaaaacaggctttctcagtaattttcaggagctctcactgacaataagcttttttaaaaaatttccattgtaaatcactctaaaccgaattttttttggcctgtaatcacattgctttcttggttgaaagagaactagttttatttgtatagtagaagatagttgtattttctcatttttttctacatgagactaaatgactatagtttcattaaaccttctttgcttttgaattcaatgtatgagtagaatattttgttctttttaaatttaaaaactgttagatttttgtggccgggcatggtggctcacgcctgtaatcctagcactttgggaggccgaggcaggtggatcacctgagttgaggagtttgagaccagcctggccaacatggtgaaaccccgtctctac

SEQ ID NO: 198712 - DNA, 392 bp, Homo sapiens
  Payload ID: 19215
  Gene Name: vacuolar protein sorting 8 homolog (S. cerevisiae)
  ENST ID: ENST00000452140
  CDS Start-End: 1-173
cagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaacatgcctagaacagatccagcacaatgcctgtaacccagtagatgtcagataaatgttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagaca

SEQ ID NO: 198713 - DNA, 661 bp, Homo sapiens
  Payload ID: 19215
  Gene Name: vacuolar protein sorting 8 homolog (S. cerevisiae)
  ENST ID: ENST00000453056
  CDS Start-End: 440-661
gtgtcgtacgttggcccggaactgggtcgggcaatttccacttactggttccaaatgaatgtgaaaattcaaatgggcttaagtaaaaagggatttattggctccaaacctggaaggggctgaggtatcactaaatccagtgactccggtgatgtatttgtgtatctctccctttctgcaaagggccagtaacccctcagttccctatctactttgcgactataattgcaagcctcattctgtcctgttacagtcgtgcggcaattaggctgagggactggcgcgcccgctcccccgactgtgagcctaggcggcgggtgtcatgcccctccccactcccgggcggaacagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgag

SEQ ID NO: 198714 - DNA, 653 bp, Homo sapiens
  Payload ID: 19215
  Gene Name: vacuolar protein sorting 8 homolog (S. cerevisiae)
  ENST ID: ENST00000424721
  CDS Start-End: 89-295
agataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgggtctcactctgttgtccaggttggagtacagtggtgcaaacatggctcactgaagcttcaacctcctgggctcaagtgatcctcctacctcagcctcccaagtagctgggaccacagattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagct

SEQ ID NO: 198715 - DNA, 552 bp, Homo sapiens
  Payload ID: 19215
  Gene Name: vacuolar protein sorting 8 homolog (S. cerevisiae)
  ENST ID: ENST00000421069
  CDS Start-End: 1-180
gaccggatggtagaaatcctattccattatgcagatcgagctctgaaaaagtgcccagaccaaggaaaaatccaagtgatggagcagcattttcaggctattggcatggcatatcgtaatgattggtttttgaatattgaaccagtcttgcatcctggaataaacctcacttggtcatgaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcag

SEQ ID NO: 198716 - DNA, 5011 bp, Homo sapiens
  Payload ID: 19215
  Gene Name: vacuolar protein sorting 8 homolog (S. cerevisiae)
  Uniprot ID: Q8N3P4
  ENST ID: ENST00000436792
  CDS Start-End: 144-4424
agtgggtgcggtcacgtgggccggcggtccacggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttctgcaggtc

SEQ ID NO: 198717 - DNA, 4721 bp, Homo sapiens
  Payload ID: 19215
  Gene Name: vacuolar protein sorting 8 homolog (S. cerevisiae)
  Uniprot ID: Q8N3P4
  ENST ID: ENST00000446204
  CDS Start-End: 132-4142
cacgtgggccggcggtccacggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttc

SEQ ID NO: 198718 - DNA, 946 bp, Homo sapiens
  Payload ID: 19215
  Gene Name: vacuolar protein sorting 8 homolog (S. cerevisiae)
  ENST ID: ENST00000458721
  CDS Start-End: 1-326
tggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaagacttcagatgagtcaaaaccccatcctagtcctttcaggagcttccttgatgtttttgtggaacttgtcatgaaagaccatacctgtgaataaataaaccatttaccactttctacaattgacatgatatacatataaagaaattacacatttaggaaaaagtaaataatctcaacagggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaa

SEQ ID NO: 198719 - DNA, 549 bp, Homo sapiens
  Payload ID: 19215
  Gene Name: vacuolar protein sorting 8 homolog (S. cerevisiae)
  ENST ID: ENST00000441141
  CDS Start-End: 128-549
atttgagattctggaagccagtgatgcagtcttgcttggagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaat

SEQ ID NO: 198720 - DNA, 811 bp, Homo sapiens
  Payload ID: 19215
  Gene Name: vacuolar protein sorting 8 homolog (S. cerevisiae)
  ENST ID: ENST00000422105
  CDS Start-End: 206-811
cggtccacggccggaatggcagcaagctcaggggaactggagcactaccctggggtttggaatgtaaagaaggcattaattgcagcttttggcaccgatttacccttatgctgttagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttgatcagaatcaagctttgcgactctgtctgggtagcactagtgttggaggtcagtatggcgctatctctgcc

SEQ ID NO: 198721 - DNA, 185 bp, Homo sapiens
  Payload ID: 19215
  Gene Name: vacuolar protein sorting 8 homolog (S. cerevisiae)
  ENST ID: ENST00000426319
  CDS Start-End: 1-185
cacttcatggatcagttatgcgccattcacttttgaagggaatttctgcccagatagtgtctgcagctgtggagagtaactcatatttgctagaatgggaaccacctgttgaggattacatttccatgacgttttctgaatttaatccttatgacaaagtagatgctggcttgcctacagcaatt

SEQ ID NO: 198722 - DNA, 592 bp, Homo sapiens
  Payload ID: 19215
  Gene Name: vacuolar protein sorting 8 homolog (S. cerevisiae)
  ENST ID: ENST00000445089
  CDS Start-End: 228-592
gatcagctgctgtgtcatatcggcacggggaatagaatggtgaacaaggcagatctggtctttgctctctcatggaacctgcattccaactgggggcaaggaatggtggtttagacaatgaggaaatcattacaatgtgagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaatt

SEQ ID NO: 198723 - DNA, 207 bp, Homo sapiens
  Payload ID: 19215
  Gene Name: vacuolar protein sorting 8 homolog (S. cerevisiae)
  ENST ID: ENST00000628962
  CDS Start-End: 1-207
atggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgggtctcactctgttgtccaggttggagtacagtggtgcaaacatggctcactga

SEQ ID NO: 198724 - DNA, 4969 bp, Homo sapiens
  Payload ID: 19215
  Gene Name: vacuolar protein sorting 8 homolog (S. cerevisiae)
  Uniprot ID: Q8N3P4
  ENST ID: ENST00000625842
  CDS Start-End: 108-4394
ggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttggaaaagatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaa

SEQ ID NO: 198725 - DNA, 2712 bp, Homo sapiens
  Payload ID: 19216
  Gene Name: vacuole membrane protein 1
  Uniprot ID: Q96GC9
  ENST ID: ENST00000262291
  CDS Start-End: 311-1531
gacaagttccggatcaagaatcacaaagcgagcagtcattcttcctcttgccacacccacagggcccgcactaagagcctaactgaaatcccgcgaggatcaaccgagctcgccgaaaggagggaggaacgtatcccttctggaggctgtctcagggggcagagggaccggaccggaagtgacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaattgtgtccgttttcttgagcgttttgattttttacttttagcttataccagctgaatggcagccttgcctaatccacctacaacaagaatttcttaagctttcttttatttgcatgagagagccactaccaaggcatgttttgttatgctgaaactgggctgctgcatactgctaaatggcacctctgggattggcctacctggggatttcttggtttgtgaaaacaggagaggagaaatatctcatacaagtgaaaggatactggagagagaaattacccatttctaaaaaaaaaccacactctgtcgtatctgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctt

SEQ ID NO: 198726 - DNA, 606 bp, Homo sapiens
  Payload ID: 19216
  Gene Name: vacuole membrane protein 1
  ENST ID: ENST00000587259
  CDS Start-End: 330-606
tgttcctgtcacccaggctggagcgcaatggcacgatcttggctcactgcaacctccgcctcgggggtccaagcgattctcctgcctcagcctcccgagtagctgggattacagccacccaccaccacgccaggctaatttttgtatttttagtagagacggggtttcaccatgttgcgcaggctagtcttgaactcctgacctcactatctgcctgccttggcctcccaaagtgctgggattacaggcgtgagccactgcgcctggtctattatctgtcttttactataaccatcctaacagctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgt

SEQ ID NO: 198727 - DNA, 838 bp, Homo sapiens
  Payload ID: 19216
  Gene Name: vacuole membrane protein 1
  ENST ID: ENST00000592619
  CDS Start-End: 1-176
acccctcttcagtgaatgaaaagaagaggagggagcgggaagaaaggcagaatattgtcctgtggagacagccgctcattaccttgcagtatttttctctggaaatccttgtaatcttgaaggaatggacctcaaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcg

SEQ ID NO: 198728 - DNA, 545 bp, Homo sapiens
  Payload ID: 19216
  Gene Name: vacuole membrane protein 1
  ENST ID: ENST00000585847
  CDS Start-End: 125-352
agcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaatatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatga

SEQ ID NO: 198729 - DNA, 558 bp, Homo sapiens
  Payload ID: 19216
  Gene Name: vacuole membrane protein 1
  ENST ID: ENST00000593168
  CDS Start-End: 128-352
gtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagca

SEQ ID NO: 198730 - DNA, 580 bp, Homo sapiens
  Payload ID: 19216
  Gene Name: vacuole membrane protein 1
  ENST ID: ENST00000589823
  CDS Start-End: 80-580
gtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgattatttgtccagatgaagagggcactgaaggaaccatttctttgtggagtatcatctcaaaagttaggattgaagcctgcatgtgg

SEQ ID NO: 198731 - DNA, 583 bp, Homo sapiens
  Payload ID: 19216
  Gene Name: vacuole membrane protein 1
  ENST ID: ENST00000587945
  CDS Start-End: 450-583
tgtctggagcccagcggcgggtgtgagagtccgtaaggagcagcttccaggatcctgagatccggagcagccggggtcggagcggattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgc

SEQ ID NO: 198732 - DNA, 800 bp, Homo sapiens
  Payload ID: 19216
  Gene Name: vacuole membrane protein 1
  ENST ID: ENST00000591315
  CDS Start-End: 387-800
ctgagatccggagcagccggggtcggagcgggtaggtaaactaactcagggaattggggaccgaagcctgaggctgtcctcagagcttggcgtcttccggagctctcccacttaggcattgcggatctggggcactgtgattccgacttccagcagtgttttaggacgctgctgactggatgtctcaccctggatgtctcacgctggcggtagccaggttatttgggacaccttctcatggttggtcacccggacattgaacccagacaccgggctgttcgttctcctctccgcgtacttggaagccttgctaggcttctttagagaacctcttagtcccgggatgtccaggaccttggactcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctg

SEQ ID NO: 198733 - DNA, 544 bp, Homo sapiens
  Payload ID: 19216
  Gene Name: vacuole membrane protein 1
  ENST ID: ENST00000586245
  CDS Start-End: 126-260
gagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctca

SEQ ID NO: 198734 - DNA, 341 bp, Homo sapiens
  Payload ID: 19216
  Gene Name: vacuole membrane protein 1
  ENST ID: ENST00000592106
  CDS Start-End: 108-341
gcttccaggatcctgagatccggagcagccggggtcggagcggtttgtaatgtattgctggattttattttgctgtattagctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcatt

SEQ ID NO: 198735 - DNA, 791 bp, Homo sapiens
  Payload ID: 19216
  Gene Name: vacuole membrane protein 1
  ENST ID: ENST00000591877
  CDS Start-End: 1-678
ggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattgggctggaggacaatggcgcactgcaacctccacctcccagtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaa

SEQ ID NO: 198736 - DNA, 2866 bp, Homo sapiens
  Payload ID: 19217
  Gene Name: v-akt murine thymoma viral oncogene homolog 1
  Uniprot ID: P31749
  ENST ID: ENST00000349310
  CDS Start-End: 432-1874
ggcggcggcggcaggaccgagcgcggcaggcggctggcccagcgcacgcagcgcggcccgaagacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 198737 - DNA, 2710 bp, Homo sapiens
  Payload ID: 19217
  Gene Name: v-akt murine thymoma viral oncogene homolog 1
  Uniprot ID: P31749
  ENST ID: ENST00000407796
  CDS Start-End: 276-1718
ggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 198738 - DNA, 3913 bp, Homo sapiens
  Payload ID: 19217
  Gene Name: v-akt murine thymoma viral oncogene homolog 1
  Uniprot ID: P31749
  ENST ID: ENST00000402615
  CDS Start-End: 1482-2924
aagaatatgtgcttatggtaaaggcaggcggcaggtacggaggctgtgggaagtcggggtccctccgcccccacaggcagccctgtgctggcctggtgtatacgtttctgtgcagacgtacaccaccctgtgtgagcacagatgtatttttacacatggctctggacagctgtctgactctgtcagcagcaggccttggaggggctcaggcccgtgtgggggtggggggacatccagaggtctttgagtccagccctctgcctccaggccacgcccactcagtgtcgtcagagccccctgtgcctgaggcgtgcgcggctcggagccctgccctcggagtcctgcggtgccttcctcgagtctggcctgctttccatcctgctaagtacttggggcatttccctctttgggtaaggtgtggtcttccctgtcctggcattagacacaaggcagtgggccttcctgccattctaagtgtagcttaagacaatcagtgcaaagcaaccctttgtgggtgtccagcccttgcctcgggaggccagaaaggtggcctggggggagagcgtctaagctggctgtggaaagacccatgttgggatccattccacagaggtcgtcaggggtctctgcctggcctggaggtcccagagaggaccctcctcccctcaggaaggcccatctggaagggtagcagaggactgctcacaggaagagcatgcgaagtgctctttctggggatgcctgtagttggtgatgtgggaactgggttttgagggatgcctaggagttcatccatcagaggggaaatgaggaagccatgcaggatcaatggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttc

SEQ ID NO: 198739 - DNA, 922 bp, Homo sapiens
  Payload ID: 19217
  Gene Name: v-akt murine thymoma viral oncogene homolog 1
  ENST ID: ENST00000554192
  CDS Start-End: 1-553
gcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccc

SEQ ID NO: 198740 - DNA, 3066 bp, Homo sapiens
  Payload ID: 19217
  Gene Name: v-akt murine thymoma viral oncogene homolog 1
  Uniprot ID: P31749
  ENST ID: ENST00000555528
  CDS Start-End: 654-2096
atggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattct

SEQ ID NO: 198741 - DNA, 1595 bp, Homo sapiens
  Payload ID: 19217
  Gene Name: v-akt murine thymoma viral oncogene homolog 1
  Uniprot ID: P31749
  ENST ID: ENST00000554848
  CDS Start-End: 153-1595
agtcctgcggtgccttcctcgagtctggcctgctttccatcctgctaagtacttggggcatttccctctttggaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctga

SEQ ID NO: 198742 - DNA, 705 bp, Homo sapiens
  Payload ID: 19217
  Gene Name: v-akt murine thymoma viral oncogene homolog 1
  ENST ID: ENST00000555458
  CDS Start-End: 1-511
ggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatat

SEQ ID NO: 198743 - DNA, 553 bp, Homo sapiens
  Payload ID: 19217
  Gene Name: v-akt murine thymoma viral oncogene homolog 1
  ENST ID: ENST00000555926
  CDS Start-End: 279-553
gcgcccggacgcggcggcccgtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagac

SEQ ID NO: 198744 - DNA, 3916 bp, Homo sapiens
  Payload ID: 19217
  Gene Name: v-akt murine thymoma viral oncogene homolog 1
  Uniprot ID: P31749
  ENST ID: ENST00000554581
  CDS Start-End: 1482-2924
ctttgggtaaggtgtggtcttccctgtcctggcattagacacaaggcagtgggccttcctgccattctaagtgtagcttaagacaatcagtgcaaagcaaccctttgtgggtgtccagcccttgcctcgggaggccagaaaggtggcctggggggagagcgtctaagctggctgtggaaagacccatgttgggatccattccacagaggtcgtcaggggtctctgcctggcctggaggtcccagagaggaccctcctcccctcaggaaggcccatctggaagggtagcagaggactgctcacaggaagagcatgcgaagtgctctttctggggatgcctgtagttggtgatgtgggaactgggttttgagggatgcctaggagttcatccatcagaggggaaatgaggaagccatgcaggatcaatggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcaggttagggaggctgggaaggccttttggggatgggggtgatttgtccaacggctgggggaggtgggaatggggaggtgagcaaggcagcagctctcagggcctggctgttgcgggtggtggtggcaggggctggaggctctaagcctagaataaggagaggcccaggtccagggaactgtgttcaattacatggatttgacacttggcagccctgagtgttttggggagagggaaggcaggcgggcagatgggggtcagagagcttagagggatggcagcccacctgggaaggcaggtgcgggtggagcccccaggcacgtgcagtgggtctctggctcacccagggcgaggagctgcccttagccaggcgtggcctcacattcagcttcctttgcttctcccagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 198745 - DNA, 858 bp, Homo sapiens
  Payload ID: 19217
  Gene Name: v-akt murine thymoma viral oncogene homolog 1
  ENST ID: ENST00000554585
  CDS Start-End: 1-441
ctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagggaccctaggagccctggccatcaccccagctgatggggtctgccagctgggttcggaagcctgcactctgagatgctgggtgccctgtcaccagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtg

SEQ ID NO: 198746 - DNA, 1393 bp, Homo sapiens
  Payload ID: 19218
  Gene Name: v-akt murine thymoma viral oncogene homolog 2
  Uniprot ID: P31751
  ENST ID: ENST00000311278
  CDS Start-End: 46-1362
ccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcg

SEQ ID NO: 198747 - DNA, 546 bp, Homo sapiens
  Payload ID: 19218
  Gene Name: v-akt murine thymoma viral oncogene homolog 2
  ENST ID: ENST00000358335
  CDS Start-End: 170-546
aaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagccccctgctgtctgttccctctgcctgcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccagg

SEQ ID NO: 198748 - DNA, 1795 bp, Homo sapiens
  Payload ID: 19218
  Gene Name: v-akt murine thymoma viral oncogene homolog 2
  ENST ID: ENST00000391844
  CDS Start-End: 324-533
gctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtg

SEQ ID NO: 198749 - DNA, 681 bp, Homo sapiens
  Payload ID: 19218
  Gene Name: v-akt murine thymoma viral oncogene homolog 2
  ENST ID: ENST00000392037
  CDS Start-End: 281-681
ttggggtcgctggggacattgccacatctctctgctcagaatgggtccttgagagcgggctccacgccacccttgctggccttaccctttgctgagtgggcagaacagccagagggcctcagagcccggcgtcctcagggaaggggctggtgtggaatcccctcccgccctgaccagctcctctcttgtcttgcagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactga

SEQ ID NO: 198750 - DNA, 5300 bp, Homo sapiens
  Payload ID: 19218
  Gene Name: v-akt murine thymoma viral oncogene homolog 2
  Uniprot ID: P31751
  ENST ID: ENST00000392038
  CDS Start-End: 300-1745
tgggagggggcggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgta

SEQ ID NO: 198751 - DNA, 904 bp, Homo sapiens
  Payload ID: 19218
  Gene Name: v-akt murine thymoma viral oncogene homolog 2
  ENST ID: ENST00000416994
  CDS Start-End: 618-904
gggtatcttcctagaaggagcagaacccctcagaacaaaccactagggtctccagaaggcccccgggatgggttgggatggaaaggagtgtctttcagacttgagctccaagcccctggaggacccagggtcacccctccccgggcctctcttcagcttcccagagctctcagcggaaggccctcaaccacaggcctccgggccgcacggtggggtggttccatggcaggctcttctggacagccagccaagcagcgagaggcccagctgggggagacagcctgggagcaggaccaggagggagggagtgagtgtgggaggggcgctgggtgggagctcagcctggcccccttggggcaggacccactgccaactcggcacccacagcagggcccaggtgctctgactgtgccgagcgagggacagcaagccgggtcggccaagaggagactgcatgtcagaggtcccagcaggagtttcttcagcccagccgtcctgctggagaagctcgttcgcagatgttgtttctaaggactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagag

SEQ ID NO: 198752 - DNA, 582 bp, Homo sapiens
  Payload ID: 19218
  Gene Name: v-akt murine thymoma viral oncogene homolog 2
  ENST ID: ENST00000456441
  CDS Start-End: 261-582
gcaagtttgcgggacggggagcgcaggccgcagcgtgcgcgggccgggggctggacctttcgggcgcggcgggcagatcgagcctggctggtctcagaaggacgtccaccttgggctgttgtgaggattaaatgaattaatccacgagaagctcctagaatggtgcctggtactgtactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgcca

SEQ ID NO: 198753 - DNA, 974 bp, Homo sapiens
  Payload ID: 19218
  Gene Name: v-akt murine thymoma viral oncogene homolog 2
  ENST ID: ENST00000441941
  CDS Start-End: 423-974
gatgcccatggtgtccctagagccagctgccacttctctgggcgccaccgtagctcccgacctgctgtccgcaaataaccccaggctgggaaaggcaaaggcgccttggtctctgtggaccctggccaggccccaggctccaggtaggggcccagctggcgctgcctcgcgccctcctcccctccgttctgggaacctgagacgaagcagtggcctcggcgtccctcagtctgttggttgctggtccctgaggacagaagtgaaggtcttggggtagggatcagggcctcggtcaagcccccaggactggcttctaggccccagaccgtgcatacgcaactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcgg

SEQ ID NO: 198754 - DNA, 5170 bp, Homo sapiens
  Payload ID: 19218
  Gene Name: v-akt murine thymoma viral oncogene homolog 2
  Uniprot ID: P31751
  ENST ID: ENST00000424901
  CDS Start-End: 300-1616
tgggagggggcggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgt

SEQ ID NO: 198755 - DNA, 798 bp, Homo sapiens
  Payload ID: 19218
  Gene Name: v-akt murine thymoma viral oncogene homolog 2
  ENST ID: ENST00000423127
  CDS Start-End: 440-798
gtagagggctgtacctttttggcgctgtggaagccgttgctgtgctgtatttacagggagtccgaaattgaagttcagaggaagaattgccttccaccgcatcttatcagaccctatgggtgccagggtgtgtgctgggagaagaagacagcaagagagccatgcagggggtgacacagctaccagggacctgcgttagctagcagcaggacggtgaagtcggttctagctctgcgaccttggaccacactgttcactcccatacagtggtctcagaaggacgtccaccttgggctgttgtgaggattaaatgaattaatccacgagaagctcctagaatggtgcctggtactgtactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccat

SEQ ID NO: 198756 - DNA, 554 bp, Homo sapiens
  Payload ID: 19218
  Gene Name: v-akt murine thymoma viral oncogene homolog 2
  ENST ID: ENST00000427375
  CDS Start-End: 354-554
aggtcgtgggataggcatatattgagctttgattttgactgcttaacagttttccacagtagttgaaccattttgcacctcccaccaataatgagtaagggttctggttcctctacatccgagccagcagttggccttgtcagtttttaaaattcgagccatcccagctgtgctgactccttagttgctgagatgagcttgtaaaaagcagctctgttgatcccagcagcggccagggcctccgctgcttctcggctgggagacccgagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagagg

SEQ ID NO: 198757 - DNA, 577 bp, Homo sapiens
  Payload ID: 19218
  Gene Name: v-akt murine thymoma viral oncogene homolog 2
  ENST ID: ENST00000452077
  CDS Start-End: 176-577
gctgcaagtttgcgggacggggagcgcaggccgcagcgtgcgcgggccgggggctggacctttcgggcgcggcgggcagatcgagcctggcactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgag

SEQ ID NO: 198758 - DNA, 974 bp, Homo sapiens
  Payload ID: 19218
  Gene Name: v-akt murine thymoma viral oncogene homolog 2
  ENST ID: ENST00000416362
  CDS Start-End: 577-974
aagtgctgggattacacgcgtgagccaccacgtccagcttcctgttgtctttgaatttatctcctgagcaagtcttcctccgggcgctgtggaaaggcacagatctgagtgcaggcgacagaggctcctgagggggtcgctgccacctccccaatgagcctccgcagcaccaggaaggagccccacccaccagctccagctccaagagacgcagatctctgcttccccacctgcctccctagcccatctgtgctgtctggcatcaaaatcagttttccacagtagttgaaccattttgcacctcccaccaataatgagtaagggttctggttcctctacatccgagccagcagttggccttgtcagtttttaaaattcgagccatcccagctgtgctgactccttagttgctgagatgagcttgtaaaaagcagctctgttgatcccagcagcggccagggcctccgctgcttctcggctgggagacccgagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgac

SEQ ID NO: 198759 - DNA, 564 bp, Homo sapiens
  Payload ID: 19218
  Gene Name: v-akt murine thymoma viral oncogene homolog 2
  ENST ID: ENST00000578123
  CDS Start-End: 174-564
aatgtgcgcaggcgccctgctgtgagcccgcctccttctctgccctgctcttgcgctctcgctctctcagagttcgtctctggctctttactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcct

SEQ ID NO: 198760 - DNA, 1706 bp, Homo sapiens
  Payload ID: 19218
  Gene Name: v-akt murine thymoma viral oncogene homolog 2
  ENST ID: ENST00000584288
  CDS Start-End: 386-595
gtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtgg

SEQ ID NO: 198761 - DNA, 567 bp, Homo sapiens
  Payload ID: 19218
  Gene Name: v-akt murine thymoma viral oncogene homolog 2
  ENST ID: ENST00000583859
  CDS Start-End: 270-567
aagtttgcgggacggggagcgcaggccgcagcgtgcgcgggccgggggctggacctttcgggcgcggcgggcagatcgagcctggcgtgcgcgggctaagctatcgagggggcgcgccgcatcaagtgtagagggctgtacctttttggcgctgtggaagccgttgctgtgctgtatttacagggactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtgga

SEQ ID NO: 198762 - DNA, 737 bp, Homo sapiens
  Payload ID: 19218
  Gene Name: v-akt murine thymoma viral oncogene homolog 2
  ENST ID: ENST00000492463
  CDS Start-End: 243-452
acttctctgggcgccaccgtagctcccgacctgctgtccgcaaataaccccaggctgggaaaggcaaaggcgccttggtctctgtggaccctggccaggccccaggctccaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccg

SEQ ID NO: 198763 - DNA, 158 bp, Homo sapiens
  Payload ID: 19218
  Gene Name: v-akt murine thymoma viral oncogene homolog 2
  ENST ID: ENST00000578310
  CDS Start-End: 1-158
tcctggtgcgggagaaggccactggccgctactacgccatgaagatcctgcggaaggaagtcatcattgccaagctggaaaacctcatgctggacaaagatggccacatcaagatcactgactttggcctctgcaaagagggcatcagtgacggggcc

SEQ ID NO: 198764 - DNA, 573 bp, Homo sapiens
  Payload ID: 19218
  Gene Name: v-akt murine thymoma viral oncogene homolog 2
  ENST ID: ENST00000491778
  CDS Start-End: 1-154
tcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagctgattgcagtggtatgatcatggctcactgcagcctccacctcctgggctcaagcagttctcccaccttagccccctgagtagctgagaccacagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctcca

SEQ ID NO: 198765 - DNA, 877 bp, Homo sapiens
  Payload ID: 19218
  Gene Name: v-akt murine thymoma viral oncogene homolog 2
  ENST ID: ENST00000578615
  CDS Start-End: 1-877
aagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaa

SEQ ID NO: 198766 - DNA, 488 bp, Homo sapiens
  Payload ID: 19218
  Gene Name: v-akt murine thymoma viral oncogene homolog 2
  ENST ID: ENST00000476247
  CDS Start-End: 1-321
gactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaagatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgt

SEQ ID NO: 198767 - DNA, 606 bp, Homo sapiens
  Payload ID: 19218
  Gene Name: v-akt murine thymoma viral oncogene homolog 2
  ENST ID: ENST00000486368
  CDS Start-End: 136-606
agatgcatgcggctgtggggagggcctctgagctgatcccagtttggcaagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactc

SEQ ID NO: 198768 - DNA, 525 bp, Homo sapiens
  Payload ID: 19218
  Gene Name: v-akt murine thymoma viral oncogene homolog 2
  ENST ID: ENST00000580747
  CDS Start-End: 239-525
gagagaaagctgatgcccatggtgtccctagagccagctgccacttctctgggcgccaccgtagctcccgacctgctgtccgcaaataaccccaggctgggaaaggcaaaggcgccttggtctctgtggaccctggccaggccccaggctccagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagag

SEQ ID NO: 198769 - DNA, 583 bp, Homo sapiens
  Payload ID: 19218
  Gene Name: v-akt murine thymoma viral oncogene homolog 2
  ENST ID: ENST00000596634
  CDS Start-End: 129-583
gtgcccggcggggggaccgcggccctcgagcccctccttcaggaactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgactt

SEQ ID NO: 198770 - DNA, 734 bp, Homo sapiens
  Payload ID: 19218
  Gene Name: v-akt murine thymoma viral oncogene homolog 2
  ENST ID: ENST00000489375
  CDS Start-End: 1-170
gcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagagtggtttgtggtcaagacagaatcattaagggccatacagggcctgcctgctccgaaagcccgtctgcccgaacccagctgctccgggaggcaggtgctgacggccgtctctgcacaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcc

SEQ ID NO: 198771 - DNA, 2029 bp, Homo sapiens
  Payload ID: 19218
  Gene Name: v-akt murine thymoma viral oncogene homolog 2
  ENST ID: ENST00000579047
  CDS Start-End: 303-1655
gtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctgtgagtgcctggggcccccgcgctggtgtgcctgccccaggggtggagggatgggatctgctcttaactcacttctcaaggagggccctcgaaggcccccgcttcatgtctgggagatttccccaagtctgctctcaggcccttttgctgttggtcctctttggacctggtgaggccaccaggagccattgactgcagcacgttctggagctcagtcggggggctcagggcaggaggcagcccggtccctgagcctggctgggttcactgctttacagctgtttgggttcttactctgaactcagcccagggctgggctatgctggggacacagcactgattgagccagccctgggccctgccctggaaagctcccagcccaggtagggtgggcggcctggagtggtcagggctagggcgtgggaggccagggactggggaatcccagaggaaatatccgacctggcctgcagttagggagggctttctagaggaggaagcaaacgtgtcagctggccggaggaatgacgtgtgggatgccagcaat

SEQ ID NO: 198772 - DNA, 554 bp, Homo sapiens
  Payload ID: 19218
  Gene Name: v-akt murine thymoma viral oncogene homolog 2
  ENST ID: ENST00000601166
  CDS Start-End: 1-390
gtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaagtctgtctgcaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggac

SEQ ID NO: 198773 - DNA, 456 bp, Homo sapiens
  Payload ID: 19218
  Gene Name: v-akt murine thymoma viral oncogene homolog 2
  ENST ID: ENST00000497948
  CDS Start-End: 1-352
cccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctttagggagggctttctagaggaggaagcaaacgtgtcagctggccggaggaatgacgtgtgggatgccagcaatgggagaagcatggcatagctaaggaccggcagcagccagggagatggtgatgacagcctgggcttactggagctggaccagcggacccacttcccccagttctcctactcggccagcatccg

SEQ ID NO: 198774 - DNA, 7081 bp, Homo sapiens
  Payload ID: 19219
  Gene Name: v-akt murine thymoma viral oncogene homolog 3
  Uniprot ID: Q9Y243
  ENST ID: ENST00000263826
  CDS Start-End: 113-1552
gctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctc

SEQ ID NO: 198775 - DNA, 1688 bp, Homo sapiens
  Payload ID: 19219
  Gene Name: v-akt murine thymoma viral oncogene homolog 3
  Uniprot ID: Q9Y243
  ENST ID: ENST00000336199
  CDS Start-End: 67-1464
ccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaatcggcttcctacagccagcagcacagtcacccatggaactgttggctttggattaaatgtggaattgaacgactacccagaagtgttctggaaagaagcgagatgtgtggcctgcctcaccgtcctcacccatcaaaagcaccagcaggcacgttaactcgaattctcacaaggaaaaggccattaaagctcaaggtgcatttcaaactccaggctac

SEQ ID NO: 198776 - DNA, 5127 bp, Homo sapiens
  Payload ID: 19219
  Gene Name: v-akt murine thymoma viral oncogene homolog 3
  Uniprot ID: Q9Y243
  ENST ID: ENST00000366539
  CDS Start-End: 202-1641
ccctctcctccccccgcccccccccggctccatcctccgccgccgcccgagcagctgcggggccgccaccgccgccgccgccgttgcaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgcta

SEQ ID NO: 198777 - DNA, 1575 bp, Homo sapiens
  Payload ID: 19219
  Gene Name: v-akt murine thymoma viral oncogene homolog 3
  Uniprot ID: Q9Y243
  ENST ID: ENST00000366540
  CDS Start-End: 154-1551
ctcaaatacacatcaccaaacaaattttctctattatttgggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaagtaagtttcaatagctca

SEQ ID NO: 198778 - DNA, 560 bp, Homo sapiens
  Payload ID: 19219
  Gene Name: v-akt murine thymoma viral oncogene homolog 3
  ENST ID: ENST00000552631
  CDS Start-End: 144-560
attgggcaccgcccacttcgtgggcttccaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccat

SEQ ID NO: 198779 - DNA, 4926 bp, Homo sapiens
  Payload ID: 19219
  Gene Name: v-akt murine thymoma viral oncogene homolog 3
  Uniprot ID: Q9Y243
  ENST ID: ENST00000621586
  CDS Start-End: 1-1440
atgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgcta

SEQ ID NO: 198780 - DNA, 1688 bp, Homo sapiens; identical to SEQ ID NO: 198775
  Payload ID: 19219
  Gene Name: v-akt murine thymoma viral oncogene homolog 3
  Uniprot ID: Q9Y243
  ENST ID: ENST00000613395
  CDS Start-End: 67-1464

SEQ ID NO: 198781 - DNA, 1575 bp, Homo sapiens; identical to SEQ ID NO: 198777
  Payload ID: 19219
  Gene Name: v-akt murine thymoma viral oncogene homolog 3
  Uniprot ID: Q9Y243
  ENST ID: ENST00000619536
  CDS Start-End: 154-1551

SEQ ID NO: 198782 - DNA, 560 bp, Homo sapiens; identical to SEQ ID NO: 198778
  Payload ID: 19219
  Gene Name: v-akt murine thymoma viral oncogene homolog 3
  ENST ID: ENST00000629115
  CDS Start-End: 144-560

SEQ ID NO: 198783 - DNA, 4370 bp, Homo sapiens
  Payload ID: 19220
  Gene Name: valosin containing protein
  Uniprot ID: P55072
  ENST ID: ENST00000358901
  CDS Start-End: 897-3317
taatgacgggaggaagaaaggcacaagcgctgagaaactgcaaaggctgtgggattggggttaccagagggtgcagtgacaatggggtaggagtggggtgctagtcagaaagttcagagtaggggtggttggaggcagcgttgagaaggagcaagaagtgtcagggtggtgatggcgtcttagaagatctccaggttttgggagaagatgggtgtatgggttaccacaataggactagactaatacaagggttcagtctattgtgccacgttcttccaggaggataaactccggagccaatgaactggagccaagtgggagagtccgcctctaagggattaaagggtctcctttcactaatcgatctcgccctattcctttcgttgattggctgagaattccaatccgtcgaggaagcgtagcgttgcggccaattgacgtggcgttactaggcgtgtcgcatcactgaggcgggagccaggccgcaagcgaatttcctgattggctgtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaa

SEQ ID NO: 198784 - DNA, 950 bp, Homo sapiens
  Payload ID: 19220
  Gene Name: valosin containing protein
  ENST ID: ENST00000448530
  CDS Start-End: 470-950
tcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgagtgagtgtgcgcgcgccgttcgcttgctgcggcggcgcgcaccgggaccagccgcgcaggttcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgaca

SEQ ID NO: 198785 - DNA, 722 bp, Homo sapiens
  Payload ID: 19220
  Gene Name: valosin containing protein
  ENST ID: ENST00000417448
  CDS Start-End: 377-722
actccgccggcgcggcgccccggggctttggggcgccagtctgccgtccggcctaccacccgccgaaagcctttggtccccggagagagcaggccccgcgagcccgaggccccagccgggcccggtgggcgtggactttgcgccatgtgaaggcctcaggagctctgccaccgaggcggagcccggggtcggggaaggcccgccgagctcagggaagctcacagccgcctttttggagccgggtcggcggggccggagttcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctg

SEQ ID NO: 198786 - DNA, 9942 bp, Homo sapiens
  Payload ID: 19221
  Gene Name: valosin containing protein (p97)/p47 complex interacting protein 1
  Uniprot ID: Q96JH7
  ENST ID: ENST00000310421
  CDS Start-End: 260-3928
gagagcgagagtgagtgagtgtgagtgcggggtggggtggtggccgttacgttcggggcaacggctacggcagtggagaagtaagaagagaaacaacgtccggcgcttccgccttcgcttaggaggaggaagagctggtagggaaaggaaagtgcttcgccctgggcctggactggaccgagtcgggttggtgggggtctgggctatgagcttttgagggtcgcctgggacgcggagcgagacacgagagccaggagctatgtctcagccgccgccgccgccgcctccgttgccgccgccacctcctccccctgaggctccacagactccgtcgtccttggcgtcggcggctgcttcgggggggcttttgaagcggagagaccggagaatcctttccgggagctgcccggatccgaagtgtcaggcgcgtctatttttcccggcctccggttctgtcagcatcgagtgtaccgagtgcggccagcggcacgagcagcaacagctgctgggggttgaggaggtgaccgacccggacgtagtgctacacaacctgctgcggaacgcgctgctcggggttacgggggcacccaagaagaacacggaactggtaaaggtgatgggcctttccaactatcactgcaaattgttgtcgcccatattagctcgctatggaatggacaaacagacaggccgggccaagcttctccgggacatgaaccagggcgaactgttcgattgcgccttactgggtgaccgcgccttcctcatagaaccagagcatgttaacactgtgggctatggcaaggaccgctccggaagcctcctgtatttgcatgacactctggaggacattaagcgggccaataaaagccaggaatgtctcattccagtgcatgtggacggggatggacactgcttggtgcatgctgtgtctcgggctctagtaggccgagagctcttctggcatgccttaagagagaatcttaaacagcactttcagcagcacctggcccgatatcaagctctgttccatgacttcattgatgctgctgagtgggaggacattatcaatgagtgtgaccctctgtttgtaccacctgagggtgttcccttgggcctgaggaatatccacatatttggtcttgccaatgtgctacatcgtcctattattctgttagattccctcagtggcatgagaagctctggtgattattcagccacctttctacctgggctcatccctgcagagaagtgcactgggaaagatggtcatttgaacaaaccaatctgtattgcatggagcagctccggtagaaaccattatatccccttggtaggcataaaaggggctgctttgcccaaactgcctatgaatttgcttcctaaagcatggggtgtgcctcaggaccttattaaaaagtacataaaacttgaagaggatggtggttgtgttattggaggtgacagaagtttgcaagataaatacttacttaggcttgttgctgctatggaagaagtctttatggacaaacatggtatccatcctagtttggttgctgatgtccatcagtatttctacagaaggactggagtgataggagttcagcctgaggaagtcacagcagctgctaaaaaagcagtaatggataatcgccttcacaaatgtttgctctgtggtgccctttctgaacttcatgttcctccagagtggttggctcctggagggaaattgtataacctggcaaaaagtactcatggacagctgaggactgacaaaaattacagctttcccttgaacaatttggtttgctcatatgattcagtgaaagatgttctggtaccagactatggaatgagtaacctaacagcttgtaattggtgccatggcacatctgtgcgaaaggtcagaggagatgggtctattgtgtatttggatggagacagaactaattctaggtccactggtggcaaatgtggttgtggattcaaacacttttgggatggtaaggagtatgacaatctaccagaagctttccctattactttagaatggggtggaagagtggtcagagaaacagtatattggttccagtatgaaagtgattcatctttgaatagtaatgtttacgatgttgcaatgaaacttgttaccaagcactttccaggtgaatttgggagtgaaatcctagttcagaaagttgtccacactatattgcatcagactgccaaaaagaatcccgatgattatactcctgtaaatatagatggtgctcacgcccaaagagttggagatgttcaaggacaagaatcagagtctcagctcccaactaaaattattcttactggacagaaaacaaaaactttgcacaaggaggagttaaacatgagtaaaactgaaagaactattcaacagaatattacggaacaggcttctgtaatgcagaaacggaaaacagagaagttaaaacaagaacaaaaagggcaacccaggactgtttctcccagtaccattcgtgatggtccatcctctgcacctgctacacctaccaaggctccctattcaccgacaacttctaaggagaagaagatccgaatcacaactaatgatggacgacagtccatggttacccttaagtcttcaacaaccttttttgaacttcaggaaagtatagccagagaattcaacattcctccatatttacagtgtattcgatacgggtttcctcctaaagagttaatgccaccacaggcaggaatggaaaaggaaccagttcctttacagcatggcgacagaattacaatagaaattctaaaaagtaaagctgaaggtggtcagtctgctgcagcacactcagcccacactgtgaaacaagaagatattgctgttactggtaaactgtcatctaaggaacttcaggagcaagctgaaaaagaaatgtactccttgtgtcttttagcaacattaatgggagaagatgtatggtcttatgcaaagggacttcctcacatgtttcagcagggtggtgtattctacagtattatgaagaaaaccatgggtatggctgatggcaagcattgtacttttccacatctgcctggcaaaacctttgtctataatgcttctgaagatagactggaattgtgtgtggatgctgcaggacatttccccattggtcctgatgttgaagatttagttaaagaggctgtaagtcaggttcgagcagaggctactacaagaagtagggaatcaagtccctcacatgggctattaaaactaggtagtggtggagtagtgaaaaagaaatctgagcaacttcataacgtaactgcctttcagggaaaagggcattctttaggaactgcatctggtaacccacaccttgatccaagagctagggaaacttcagttgtaagaaagcataatacagggacagactttagtaatagttccactaaaacagagccttctgtattcacagcttcttctagtaatagtgagcttattcgaatagctcctggagtagtaacaatgagagacggcaggcagcttgatcctgatttggttgaggcccagcgaaaaaaattgcaggaaatggtttcttctattcaggcttcaatggacaggcaccttcgggatcaaagtacagagcagtcaccatctgatcttcctcaaaggaaaacagaagttgtgagttcttctgcaaagtctgggagtcttcagactggtttgcctgaatcttttcctttaactggtggtactgaaaatttgaatacagaaacaactgatggctgtgtagcagatgcactgggagcagcctttgccacaaggtcaaaagcacaaaggggaaattccgtggaggagcttgaagagatggatagtcaagatgctgagatgactaacacaactgagccaatggatcactcttgatttaattagaggctaataaaggcagaatgtttattgtgaatatgtaatatttgttggctgggccacgtaacttgattagtcattaaaaatcttgtacgtatataattcaaagattatatcttgttattcagtgcatgatagcaagtgtgtgattggccatagcttttaatatactgctgcccaggctggctctgaatttctataaattagctgttagatctgctgagatgactttcttccatatatgtggttcattggaagttctttgtaattttaattccatgaaagtcttaatgtttccaacatgaaaattctcttacttaaatacgtttgatttctgaaaagcctacaaatggaggggaaatgagattgtgctaatgttgatgtcatcaaggtaaccatctcatatactagtgtcaaaaggtttatgtaaacttgaattttatctgaactaaattgtatcttaaaattcatacaattatttattagacagtggaatgcaaatgtttctatgaacgtaaacacattcatagagatttcttggcgaaaatatcttgagaatagaatgtaacgatataacattttgctgatttgtgcaagattggggaaaaatttcttctagattgatgaggtcaatgtgattcagttgtgttgctgtctgagccacagccaattgtgtgtgctctattaatatgttaccattatttttgattcctggcttggtcaagaacaacctgatttttttttttttaatcttgcagaaaagttgattgcaaagtgtggtagaaaaagaaataatggtagcagtagagaatttataaataagagtttatctttatgaatgagttaattgttctacaattttgatcagtggtatttaagcctgtatatgctaagtgtatttatgcccctttgagccaaaatttttttttttttttcagaatccataagagtttatttgttggcttcacttgggtttagatgcaaattttactgcatcacaccctgatcagctgggtatttgcttagtgtattcatcaaatcttcagtgccagtttccttgagaagcagctttcatgcttattccttaaaaacaacagaagagtgtttatcctgagattggtattgcactattttattttattctgcaaatctgtatcctgaagtgtacatttcaacccatattcttctctgttcactgaaattaagttgaatttgaatggctgaaagacaaaatatatgttaatacaatctcttacctagagcattcaaagcctggctgtctctgtttgcacatgtaacagatgcagaactgtgtttgtaattctaagaaaatgtatgtcagaaagtattttatcagatgtttaaaaatctctgcctgttgattcataagggatatagacagtactttaacttgtgtttccagataaggcagattttggtcatctttctgtgaaagtatctctaactgaatccacttcttaaacaaactactctattttaaataaggaaagaatggagaatctagacattttacaggtgtatctgagcaaaatatatatttgggttagtttttatcacattatcacgtttgtctttatattttatcttcatcctaaattttctccctatcaaaacagcaggaaatttttaaacttttatattgtacactatttttgcataaaataagagctgtagctaccaaatactatttactacttagtaaaggtggcttctgtgtattaaactacgaattacaaatatcacttcactaaccactataattatttttggctttttcagccactggaactttttttggggggatttaaatacaggaaaactgtttaagcaaaaaatgcactgctttcatgtaaaatgatataatcttctttaacaaatattttcttcattgataactgacagatatctcatagcattaacataaaataccagaaacaaactttatctccctattcttacatttagtgcaaattggaatgcgtatgtgaatgttagaagatggacttaatctctgacaactttattaatttctctagctacagcaatgctatttaaaagccagttaggtatgaatagtacagtaatagtttgggttctcccttgataaatgaataaaaggctcaattctgataagtgatcaaatttcttgaaattctttcaaatcagctgaaaatttggttggggtgaattgatggtttttgagaagtaggccaggtatcctcacaaagaagttttagaatagggtttcttttaagtttttaaatatcatcctttgtctttccatatggttttcataaccaaatacatgactatagcatggttatttttctagtactgccatttgtgatatagccacatcttggcgtgcaagctagacatctcaggtaaatttgtttttttttttttttttagccctagaggtaacattataactaaaatgcattcctgcaattctgtttgcagtgcttcactaaacattgaaataaagttgtaaattttttcttcagtaatccattttatagttaatcataccaaatttaagttgatgacctaaagtccaggtagtgttgaagatagtatgtatctagaatactggtaatgagaaattgttgtaaattgaagaaaacaagatgctgccatatattaagatagaatataattaactccatgagaatggttactcaggaactagttaaagagcaaacccatttctcccgcttcactctgtttcagatatttttattggaaaatgttagggtagaggcctgagaaagttagcaaatgctattgactgatactggctctgtgtcttccagtgatttttagtttggtttttacagtcaagcctactgcttgcaattaagatatcaatctgaaatgcatctgtaattcctggccacaggtccttattgccattatttttaagtatcttcattggagatgaacactgacttttgcatatggtctcttacctcagggaagatcacttgctagcaactcatactactaatgacaggtttttgagaattgtactgacatcacatgttagctactaaatgcaaaatgtataaaagtattgttttatgtagttacctaccaatactatctgctactgaataactctctaaatatgtagacctcactaataactaacctttaggtaaaaaatttacttctgtcattaattacacttcaactggtcaatatagtggcagcataaagtgtttatttcagaatatcaatacagttttgtcttcatttttcaacagtaatttcaattggttcatacttaaaatactacacagattttgagttttatggttctcaaagcaaggtttccatcttaagatttttataaacacaaagcctttgcaaaattggattaaattccacctatcttaatgtgaattaaaaaccaccatttataataataatagcgccatattctaagttgagtaaatgcatcctaccattcaaggttatcatataatttaacaaaattgtacaaccttaaggctcttcacagtataaattaatttttcaaaccagagctgttcacatgaaaatattccttagtagaatgtatatttaagaaataaaacaacaaaggggaactatatcacccatgtaagttatagagttaattacaagttctaccattcttgataattctttgagatgctaagtgtttcagttcatatttaatgatacttaaatcgtgggaattttaatgtttgttccaaaatagcagaaattgtaaaaattatgaattattggagaaaatgccattacttgtatatctgacatttaattttttaattatggagactacatgcttttgtagtataatattaatgattattctcttgtaaaagaaaaggaaaaattagtaaagaaaaaagttttagttgatgttacctgcttgtgagtatcaattacttagtttttaaatttttaaggtattgcctacttttctttagaatgcagaaatctcgtcctgagcccttattatgcctgtggtagagcaatgcaagactgaaaaggttgccagtattttcaggcttatttgactaagaattagtgccaagaactggaaagtctactttttggagggaaatgatacttagaatttgtaaacataagcagtaatagtgtaaatatttagaaaaatagcaagtgctttaactgctcaataaaatagtatagatgttatttcacccttaaggcactggctgttgcccattattttccgatttcgtgattactgtatatattacatttgagtaatgaataattggtaatagtgtattatagtgttctacagcacaccttactgtacagtatttgaagttttcttttatatcaataataaaactataagttaatactgattttcccctgaaattctccacattagcttttaaaggtaattttatgttctttagtttcctggaattataatgcatgaacatatagttcagttttataaagaaattcttaaataataaagttttcttgttgaacttaagcgggttatcgtacaggaatagtgatttttccccttaatgtagatttcattgctagatgaaatggacccagtgaaaaaagagtgcgcaatttaaaaaaaaaccaaaacggtctcactctgctgcccatgctggattgccgtggcatgatcagggctcactgcagcctcaacctcctgggctcaagtgatcctcccacctcagcctcctgaatagctgggactacaggcatgtgccaccacacctggctaatttttgtattttttgtagagatagggttttgccatgttgcccaggccggtcttgaacccctgagctcaagtgatctgccctcctctgcctctttaagtgctgggattacaggcgtgagccaccgcaccctgccagcaaaatttctttagacatattacataattgggccataatgcttactgaatatttaaaaatgaaggcaaattctaacagagaacttgattttgtggtggtttaaaaaaatactggttagtgataaggaaatgaaaggaaatacagataatagtactaaataacgtttgtgtagcttagcagtcaacacgtttacttccaagttttattgtatatgcttaatatacattttattagatcatttaactcaataatttagagtatagccttagacaccagactgcctaggtctgactcctggtacgctgctttctgtgacctctctgtgcattcctctctgcgaggatgatgatcacatctgctcccagggtggctgtcttaaatgagttaacacgtatctgatgattagaagagtgcctgacacatagtaaacactcaaatatttgctatgttatatgttaatgtaatgtggtagagttcagttgccattaagtgggataaatcctcacagggcacacattatttaaataatttgttacattaaaacttattttacttgtacataattgactaaaaaatggggggttgtacattcaaacatttatgaccatgtgcaacactgagaatctcaaaccgacagtgtgctctgtgacccaaggcaagtcttggagcctttcaaggcctcaatttcttctgtaaccttgtggtttcacaattgtcaaccttttgttctgccgaccattgtcgtcatagtcttacttgcagagggcatagtgctgatgggacaagtgacatgggtatgagccccatgtaaactaaaacataattacctttcctttaggtgttggctacagttatcccaaacttggacttgaggtcttgtatatgcatgccattggtcacataccatcagaatagaattctcaaaaactctttagtaaataagataaacatcctacttataacagctcattatggattttatttttattgtctggctctttcagaccccagcaactgcaattctgacttaataatcaattgtttctaatcattaaaaatgtatatagaaaaactgaa

SEQ ID NO: 198787 - DNA, 795 bp, Homo sapiens
  Payload ID: 19222
  Gene Name: valosin containing protein lysine (K) methyltransferase
  Uniprot ID: Q9H867
  ENST ID: ENST00000395859
  CDS Start-End: 49-633
gcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggtactgaaatggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgca

SEQ ID NO: 198788 - DNA, 1761 bp, Homo sapiens
  Payload ID: 19222
  Gene Name: valosin containing protein lysine (K) methyltransferase
  Uniprot ID: Q9H867
  ENST ID: ENST00000395860
  CDS Start-End: 6-695
gcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggtactgaaatggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattagccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttataggcattggtgctagatggtacattttatgtgttaaaataaacattgtttttgagacctt

SEQ ID NO: 198789 - DNA, 1793 bp, Homo sapiens
  Payload ID: 19222
  Gene Name: valosin containing protein lysine (K) methyltransferase
  Uniprot ID: Q9H867
  ENST ID: ENST00000491402
  CDS Start-End: 49-483
gcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattagccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttataggcattggtgctagatggtacattttatgtgttaaaataaacattgtttttgagacctt

SEQ ID NO: 198790 - DNA, 4312 bp, Homo sapiens
  Payload ID: 19223
  Gene Name: valyl-tRNA synthetase
  Uniprot ID: P26640
  ENST ID: ENST00000211402
  CDS Start-End: 442-4236
cacaaggtgcccgtggcggcgcctgacgggagcgtcgtgctcaggggtgtcctctcgtcctgcgtccgcgcccagcgccccgcgccccgcgctgttcctcgtgagaccggcgggcggcgagccgcgcggcccccggggcagtgtcggacacggcgggcgcgcactcgcaggcggggcacggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 198791 - DNA, 4312 bp, Homo sapiens; identical to SEQ ID NO: 198790
  Payload ID: 19223
  Gene Name: valyl-tRNA synthetase
  Uniprot ID: P26640
  ENST ID: ENST00000375663
  CDS Start-End: 442-4236

SEQ ID NO: 198792 - DNA, 284 bp, Homo sapiens
  Payload ID: 19223
  Gene Name: valyl-tRNA synthetase
  ENST ID: ENST00000455956
  CDS Start-End: 1-284
ggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatac

SEQ ID NO: 198793 - DNA, 863 bp, Homo sapiens
  Payload ID: 19223
  Gene Name: valyl-tRNA synthetase
  ENST ID: ENST00000445152
  CDS Start-End: 1-863
gaaggagcggggactgttccgtggcattgaggacaaccccatggtggtgccactttgcaaccggtcgaaggacgtggtagagcctctgctgcggccgcagtgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccct

SEQ ID NO: 198794 - DNA, 3627 bp, Homo sapiens
  Payload ID: 19223
  Gene Name: valyl-tRNA synthetase
  ENST ID: ENST00000425144
  CDS Start-End: 1-3551
caggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 198795 - DNA, 1541 bp, Homo sapiens
  Payload ID: 19223
  Gene Name: valyl-tRNA synthetase
  ENST ID: ENST00000424974
  CDS Start-End: 442-1541
cacaaggtgcccgtggcggcgcctgacgggagcgtcgtgctcaggggtgtcctctcgtcctgcgtccgcgcccagcgccccgcgccccgcgctgttcctcgtgagaccggcgggcggcgagccgcgcggcccccggggcagtgtcggacacggcgggcgcgcactcgcaggcggggcacggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatg

SEQ ID NO: 198796 - DNA, 863 bp, Homo sapiens; identical to SEQ ID NO: 198793
  Payload ID: 19223
  Gene Name: valyl-tRNA synthetase
  ENST ID: ENST00000435299
  CDS Start-End: 1-863

SEQ ID NO: 198797 - DNA, 4312 bp, Homo sapiens
  Payload ID: 19223
  Gene Name: valyl-tRNA synthetase
  Uniprot ID: P26640
  ENST ID: ENST00000422694
  CDS Start-End: 442-4236
cacaaggtgcccgtggcggcgcctgacgggagcgtcgtgctcaggggtgtcctctcgtcctgcgtccgcgcccagcgccccgcgccccgcgctgttcctcgtgagaccggcgggcggcgagccgcgcggcccccggggcagtgtcggacacggcgggcgcgcactcgcaggcggggcacggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactagctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 198798 - DNA, 4312 bp, Homo sapiens; identical to SEQ ID NO: 198790
  Payload ID: 19223
  Gene Name: valyl-tRNA synthetase
  Uniprot ID: P26640
  ENST ID: ENST00000457796
  CDS Start-End: 442-4236

SEQ ID NO: 198799 - DNA, 804 bp, Homo sapiens
  Payload ID: 19223
  Gene Name: valyl-tRNA synthetase
  ENST ID: ENST00000417430
  CDS Start-End: 283-804
ctcctgagagccttccacactccccgaagccccgcgatggtggatagttcctcttccccaggaactccccactgacactgcccctctgagagccaggtcctcggctcctgacagcctgcctggtcagaccctcagtcctatgggactcgggtgtctgcggcgaaggagctcccgtgagggtcccctctctactcaaacataggacccacctcgatcccgcagtcttcccctgtctctctttctccttaggtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactagctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatac

SEQ ID NO: 198800 - DNA, 863 bp, Homo sapiens; identical to SEQ ID NO: 198793
  Payload ID: 19223
  Gene Name: valyl-tRNA synthetase
  ENST ID: ENST00000420919
  CDS Start-End: 1-863

SEQ ID NO: 198801 - DNA, 863 bp, Homo sapiens; identical to SEQ ID NO: 198793
  Payload ID: 19223
  Gene Name: valyl-tRNA synthetase
  ENST ID: ENST00000446350
  CDS Start-End: 1-863

SEQ ID NO: 198802 - DNA, 804 bp, Homo sapiens; identical to SEQ ID NO: 198799
  Payload ID: 19223
  Gene Name: valyl-tRNA synthetase
  ENST ID: ENST00000419375
  CDS Start-End: 283-804

SEQ ID NO: 198803 - DNA, 804 bp, Homo sapiens
  Payload ID: 19223
  Gene Name: valyl-tRNA synthetase
  ENST ID: ENST00000424984
  CDS Start-End: 283-804
ctcctgagagccttccacactccccgaagccccgcgatggtggatagttcctcttccccaggaactccccactgacactgcccctctgagagccaggtcctcggctcctgacagcctgcctggtcagaccctcagtcctatgggactcgggtgtctgcggcgaaggagctcccgtgagggtcccctctctactcaaacataggacccacctcgatcccgcagtcttcccctgtctctctttctccttaggtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatac

SEQ ID NO: 198804 - DNA, 804 bp, Homo sapiens; identical to SEQ ID NO: 198803
  Payload ID: 19223
  Gene Name: valyl-tRNA synthetase
  ENST ID: ENST00000440048
  CDS Start-End: 283-804

SEQ ID NO: 198805 - DNA, 804 bp, Homo sapiens; identical to SEQ ID NO: 198803
  Payload ID: 19223
  Gene Name: valyl-tRNA synthetase
  ENST ID: ENST00000425864
  CDS Start-End: 283-804

SEQ ID NO: 198806 - DNA, 4312 bp, Homo sapiens; identical to SEQ ID NO: 198797
  Payload ID: 19223
  Gene Name: valyl-tRNA synthetase
  Uniprot ID: P26640
  ENST ID: ENST00000435657
  CDS Start-End: 442-4236

SEQ ID NO: 198807 - DNA, 863 bp, Homo sapiens; identical to SEQ ID NO: 198793
  Payload ID: 19223
  Gene Name: valyl-tRNA synthetase
  ENST ID: ENST00000428445
  CDS Start-End: 1-863

SEQ ID NO: 198808 - DNA, 804 bp, Homo sapiens; identical to SEQ ID NO: 198803
  Payload ID: 19223
  Gene Name: valyl-tRNA synthetase
  ENST ID: ENST00000428505
  CDS Start-End: 283-804

SEQ ID NO: 198809 - DNA, 863 bp, Homo sapiens; identical to SEQ ID NO: 198793
  Payload ID: 19223
  Gene Name: valyl-tRNA synthetase
  ENST ID: ENST00000428796
  CDS Start-End: 1-863

SEQ ID NO: 198810 - DNA, 4073 bp, Homo sapiens
  Payload ID: 19224
  Gene Name: valyl-tRNA synthetase 2, mitochondrial
  Uniprot ID: Q5ST30
  ENST ID: ENST00000321897
  CDS Start-End: 633-3824
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaa

SEQ ID NO: 198811 - DNA, 4073 bp, Homo sapiens
  Payload ID: 19224
  Gene Name: valyl-tRNA synthetase 2, mitochondrial
  ENST ID: ENST00000383369
  CDS Start-End: 633-3824
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggtgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccagcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaa

SEQ ID NO: 198812 - DNA, 4073 bp, Homo sapiens
  Payload ID: 19224
  Gene Name: valyl-tRNA synthetase 2, mitochondrial
  ENST ID: ENST00000383540
  CDS Start-End: 633-3824
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcaggtggagatcgccgcggccctggcgggactctttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacgggaaagatggaacaaggggagtgacccttctccacccccatatcctaatgtgctctctctctatccagaacagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctattccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccctagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcacagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaa

SEQ ID NO: 198813 - DNA, 1103 bp, Homo sapiens
  Payload ID: 19224
  Gene Name: valyl-tRNA synthetase 2, mitochondrial
  ENST ID: ENST00000452966
  CDS Start-End: 126-1103
cgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatgga

SEQ ID NO: 198814 - DNA, 460 bp, Homo sapiens
  Payload ID: 19224
  Gene Name: valyl-tRNA synthetase 2, mitochondrial
  ENST ID: ENST00000434089
  CDS Start-End: 116-460
acgctgcgggtcctgggcccaggccttgggatgggcgggaaggcttggccgcgccgggctgtgggcactgcaggaggcccctgtgcagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccg

SEQ ID NO: 198815 - DNA, 4073 bp, Homo sapiens
  Payload ID: 19224
  Gene Name: valyl-tRNA synthetase 2, mitochondrial
  ENST ID: ENST00000428577
  CDS Start-End: 633-3824
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctctctctgcggggactggctgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggtcgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccaagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaa

SEQ ID NO: 198816 - DNA, 4073 bp, Homo sapiens; identical to SEQ ID NO: 198810
  Payload ID: 19224
  Gene Name: valyl-tRNA synthetase 2, mitochondrial
  ENST ID: ENST00000415079
  CDS Start-End: 633-3824

SEQ ID NO: 198817 - DNA, 460 bp, Homo sapiens
  Payload ID: 19224
  Gene Name: valyl-tRNA synthetase 2, mitochondrial
  ENST ID: ENST00000433908
  CDS Start-End: 116-460
acgctgcgggtcctgggcccaggccttgggatgggcgggaaggcctggccgcgccgggctgtgggcactgcaggaggcccctgtgcagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccg

SEQ ID NO: 198818 - DNA, 1103 bp, Homo sapiens
  Payload ID: 19224
  Gene Name: valyl-tRNA synthetase 2, mitochondrial
  ENST ID: ENST00000428017
  CDS Start-End: 126-1103
cgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatgga

SEQ ID NO: 198819 - DNA, 1103 bp, Homo sapiens; identical to SEQ ID NO: 198818
  Payload ID: 19224
  Gene Name: valyl-tRNA synthetase 2, mitochondrial
  ENST ID: ENST00000411697
  CDS Start-End: 126-1103

SEQ ID NO: 198820 - DNA, 4073 bp, Homo sapiens; identical to SEQ ID NO: 198812
  Payload ID: 19224
  Gene Name: valyl-tRNA synthetase 2, mitochondrial
  ENST ID: ENST00000450090
  CDS Start-End: 633-3824

SEQ ID NO: 198821 - DNA, 460 bp, Homo sapiens
  Payload ID: 19224
  Gene Name: valyl-tRNA synthetase 2, mitochondrial
  ENST ID: ENST00000443384
  CDS Start-End: 116-460
acgctgcgggtcctgggcccaggccttgggatgggcgggaaggcctggccgcgccgggctgtgggcactgcaggaggcccctgtgcagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccg

SEQ ID NO: 198822 - DNA, 460 bp, Homo sapiens; identical to SEQ ID NO: 198817
  Payload ID: 19224
  Gene Name: valyl-tRNA synthetase 2, mitochondrial
  ENST ID: ENST00000414570
  CDS Start-End: 116-460

SEQ ID NO: 198823 - DNA, 460 bp, Homo sapiens; identical to SEQ ID NO: 198814
  Payload ID: 19224
  Gene Name: valyl-tRNA synthetase 2, mitochondrial
  ENST ID: ENST00000416187
  CDS Start-End: 116-460

SEQ ID NO: 198824 - DNA, 1103 bp, Homo sapiens; identical to SEQ ID NO: 198818
  Payload ID: 19224
  Gene Name: valyl-tRNA synthetase 2, mitochondrial
  ENST ID: ENST00000431578
  CDS Start-End: 126-1103

SEQ ID NO: 198825 - DNA, 1103 bp, Homo sapiens; identical to SEQ ID NO: 198813
  Payload ID: 19224
  Gene Name: valyl-tRNA synthetase 2, mitochondrial
  ENST ID: ENST00000446577
  CDS Start-End: 126-1103

SEQ ID NO: 198826 - DNA, 1103 bp, Homo sapiens; identical to SEQ ID NO: 198818
  Payload ID: 19224
  Gene Name: valyl-tRNA synthetase 2, mitochondrial
  ENST ID: ENST00000425563
  CDS Start-End: 126-1103

SEQ ID NO: 198827 - DNA, 460 bp, Homo sapiens; identical to SEQ ID NO: 198814
  Payload ID: 19224
  Gene Name: valyl-tRNA synthetase 2, mitochondrial
  ENST ID: ENST00000421263
  CDS Start-End: 116-460

SEQ ID NO: 198828 - DNA, 4064 bp, Homo sapiens
  Payload ID: 19224
  Gene Name: valyl-tRNA synthetase 2, mitochondrial
  ENST ID: ENST00000542001
  CDS Start-End: 633-3818
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacggtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 198829 - DNA, 3566 bp, Homo sapiens
  Payload ID: 19224
  Gene Name: valyl-tRNA synthetase 2, mitochondrial
  Uniprot ID: Q5ST30
  ENST ID: ENST00000541562
  CDS Start-End: 82-3363
ggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctg

SEQ ID NO: 198830 - DNA, 4064 bp, Homo sapiens
  Payload ID: 19224
  Gene Name: valyl-tRNA synthetase 2, mitochondrial
  ENST ID: ENST00000550773
  CDS Start-End: 633-3818
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcaggtggagatcgccgcggccctggcgggactctttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacgggaaagatggaacaaggggagtgacccttctccacccccatatcctaatgtgctctctctctatccagaacagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacggtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctattccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccctagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcacagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 198831 - DNA, 3609 bp, Homo sapiens
  Payload ID: 19224
  Gene Name: valyl-tRNA synthetase 2, mitochondrial
  ENST ID: ENST00000546854
  CDS Start-End: 82-3363
ggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 198832 - DNA, 3609 bp, Homo sapiens
  Payload ID: 19224
  Gene Name: valyl-tRNA synthetase 2, mitochondrial
  ENST ID: ENST00000553245
  CDS Start-End: 82-3363
ggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccagcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 198833 - DNA, 3609 bp, Homo sapiens
  Payload ID: 19224
  Gene Name: valyl-tRNA synthetase 2, mitochondrial
  ENST ID: ENST00000548165
  CDS Start-End: 82-3363
ggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctctctctgcggggactggctgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggtcgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccaagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 198834 - DNA, 4064 bp, Homo sapiens; identical to SEQ ID NO: 198830
  Payload ID: 19224
  Gene Name: valyl-tRNA synthetase 2, mitochondrial
  ENST ID: ENST00000547340
  CDS Start-End: 633-3818

SEQ ID NO: 198835 - DNA, 4064 bp, Homo sapiens
  Payload ID: 19224
  Gene Name: valyl-tRNA synthetase 2, mitochondrial
  ENST ID: ENST00000549900
  CDS Start-End: 633-3818
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggtgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacggtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccagcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 198836 - DNA, 4064 bp, Homo sapiens; identical to SEQ ID NO: 198828
  Payload ID: 19224
  Gene Name: valyl-tRNA synthetase 2, mitochondrial
  ENST ID: ENST00000551709
  CDS Start-End: 633-3818

SEQ ID NO: 198837 - DNA, 3609 bp, Homo sapiens
  Payload ID: 19224
  Gene Name: valyl-tRNA synthetase 2, mitochondrial
  ENST ID: ENST00000549458
  CDS Start-End: 82-3363
ggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcagaacagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctattccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccctagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcacagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 198838 - DNA, 4064 bp, Homo sapiens
  Payload ID: 19224
  Gene Name: valyl-tRNA synthetase 2, mitochondrial
  ENST ID: ENST00000548842
  CDS Start-End: 633-3818
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacggtgaaggtgactccagctcacagtcctgccgatgctgagatgggggcccgacatggcttgagccccttgaatgtcattgcggaggatgggaccatgacctctctctgcggggactggctgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggtcgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccaagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 198839 - DNA, 3609 bp, Homo sapiens; identical to SEQ ID NO: 198837
  Payload ID: 19224
  Gene Name: valyl-tRNA synthetase 2, mitochondrial
  ENST ID: ENST00000552560
  CDS Start-End: 82-3363

SEQ ID NO: 198840 - DNA, 3362 bp, Homo sapiens
  Payload ID: 19224
  Gene Name: valyl-tRNA synthetase 2, mitochondrial
  Uniprot ID: Q5ST30
  ENST ID: ENST00000625423
  CDS Start-End: 345-3116
tgcgccggccggggccccgcccccatgcgccgcgcggctccagggccacgttccagggtcgggtttggtggattcctcagtccctgccgccgcggggcgccctgggatagcggcggggcctcctgtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 198841 - DNA, 1227 bp, Homo sapiens
  Payload ID: 19225
  Gene Name: VAMP (vesicle-associated membrane protein)-associated protein A, 33kDa
  Uniprot ID: Q9P0L0
  ENST ID: ENST00000340541
  CDS Start-End: 196-1080
tcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgggtataactccaccagggaatgctccgactgtcacttcaatgagcagcatcaacaacacagttgcaacacctgccagttatcacacgaaggatgaccccaggggactcagtgtgttgaaacaggagaaacagaagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatct

SEQ ID NO: 198842 - DNA, 6815 bp, Homo sapiens
  Payload ID: 19225
  Gene Name: VAMP (vesicle-associated membrane protein)-associated protein A, 33kDa
  Uniprot ID: Q9P0L0
  ENST ID: ENST00000400000
  CDS Start-End: 256-1005
tcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataaatgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttctttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattcgagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaagcagtggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttatgtactataggcacttaagaaccctgaggaaaaataatacaatgtgtgtgtgtgagagagagagtgagttactgacattgttccaaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaattcaaaatgtatatccttaattgtatataatatgtagataaatatatgagggtattaagctactttgaattaaatttaaggatatatttcacatgaaaacaaatacaaacgagaatcaaaataaagttttgcaaagta

SEQ ID NO: 198843 - DNA, 567 bp, Homo sapiens
  Payload ID: 19225
  Gene Name: VAMP (vesicle-associated membrane protein)-associated protein A, 33kDa
  ENST ID: ENST00000585042
  CDS Start-End: 195-284
cagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaagtcatagtataacatcagtaacaaaaatgagcatctcccttgccccagaaggctgccaaaagaatggaaagaagtgttttcattttttatttaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacaca

SEQ ID NO: 198844 - DNA, 1834 bp, Homo sapiens
  Payload ID: 19226
  Gene Name: VAMP (vesicle-associated membrane protein)-associated protein B and C
  Uniprot ID: O95292
  ENST ID: ENST00000395802
  CDS Start-End: 148-447
gcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaa

SEQ ID NO: 198845 - DNA, 7936 bp, Homo sapiens
  Payload ID: 19226
  Gene Name: VAMP (vesicle-associated membrane protein)-associated protein B and C
  Uniprot ID: O95292
  ENST ID: ENST00000475243
  CDS Start-End: 339-1070
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatgtgtgcatgtgtgcatgtgtggcatatgtgccgtatgtcagtagcttgacagttttcaaatcgtgcctatatttttttgcatacacaaatttttgtgtttgcaaactcagaatccatgccaaaatacaatgttatatgtcattttcagctccttctctaaaggaatggcccatttctcattgtagtttgagaaatacatgtatgaagagataggggtcttgggcttcccagtgtcactttgaacacctgaataacatttaactcctgagaccttctcggtgtagaggccactgcttccccctgctggagatggcatttcattgaagggcctctcgtggctttccctgcccccggctgtctggcctgaagaaggagaaagaaccaaactgaactatgaaaagttaccactctgaggagacctctcttaattaacacttggggccatgtttgctgttgttgagaaggagtgttctcaaagatgagctggaatggaattgtatttagaaaggcccctgcaaagtatatagatggatgactctagttcatgacatacaaatcccataaggccaacgaccactcttctggaacaccaagagcagctctgagatcatgctggccctacgcgaattgagtttctgtggcctaattggatttggagaacgccttccctggccccttttcctcagacagatctgctctgataggaaccttttcaagaaagttactgttgtttcaatgccactccttacctgtatagaacatttccaatacattcgctcattgaacttaatccttgcaactgtgactggggggtagatggctctgtttgcatacgaagaaataaaggctccaggaggttaaatcgggcaactttttagaactaaatcagtctctgtaaggcctacattgctaagataccatttcagctctgaaaatctgcttcagggaagtgagtggatgaggccttcctgcctcagctactctgcccgtctgtacatcttttgtgtctgcctccgtaccttattcagttattttcacactaaagtaagtagaattaagactgtagttcagatgctttttctttttctgttggaaactgaacacactacagacagtgaaaaaaggtacatattccattttctcattgcctgaagatctctgctgatgctcctggagaatgactttgggggctttagaaagaatattgccagtccgtctcggcaaggagatgatgggagcgctttatatggaggctttacatgacttgtaaattaaatgtgaatgagggcagttgattaaaattggtattacagaagggccctgctgaggtttgaaaacagctgagctgctgatgtctcaggcctttccctgaattagcactgcggttctccaggatatcagcaaagagggcaagtaatagaagcccctgataaggagcgtcagccgacaggcaagcttgggaggctgtgggaatgggtctgcccccagcttcacagacctcttcctccagcctctgaatcccattagccacagcctagaacattagctgagctgcacaagctcacccacccctgtgccagggggccctgacctccctccatgccatgtttttggctgtatctacggcacttaacaataggggctttttattttcattacagagatattttgaaaaatttaaaagacatgaactcacataaacagttatggatgatagttaaaagagaaacgggtggaggtggatgagaggttgtcttcatgaatataattacttgagatttttttttcttaatggaattagtttattagaaaatgtctgtgttaaatccgtagaaaaggaagaaaagtgtagcaacaaaaatgtagccattatctaacttgccataaatatttgcagttatgataccttggaatgttgccacgatatggattgctttgattaaaagatgtcagttgaataaaacagtactgtgggagaatcgctttctgctgctagataaatgctgatgtttatttttaaaccaggaaacattgatcctgtaacaatgcccgattacaattgctttattacaccccagggctgatggagatgtaatcacttggctaatggatgtgggtgcaggacagatgctcgcttgctggcctgctttcctgcttgcattctgatgagctgcaggagtgcgcctggccttctgcaggtggagctgctgtcagagcttcgtttcactgatacccaaagccatgtctgactgaaataaaacaggttccctttttttttccctttggaaaatgccaactaagggagactaatcagatatcttaacacaatttcatccaggcttagtgctaacaagattgcggggctttttagggtttaagaagatgagaaatgagtgtgcacgtttcacacgttgacttgccggtttttccatgtcatacaaaaaagtcctggctgtttctccgaactggctgcctgcattcccgtctttcttttgtttttaagaaatagactgaattcagctgttaatcctctagtacagtatccatgttaaaatgtttttccattgcatcttttatgtgaattcaaaggtcagaatttattgtctgtgatattgagaccatgtgtacaagaactactttttgcttttcatcattcactccttagcaaacgtttcgtaagtaccctctgtctgtttgctactatatgaggtgctgcgaaattagtgggcgtggctttttatatttttcattcgtgtgtagcctaagtaaggtgactcaagatgatacaccgagagaaaaatgcaaaatatatttggttctcatttctgttgctgtcgtttcctttttaaagacgatttatcaactgctgccatttggaacttcctataagaaactaaaaatgatctatttcagtgttcctttcgcctttcctctgctttctgaataaatggtttcagtaacccatgctgttctctccctattctacgtctttctccctatgttgaaaaaagattcccacagtttctgatgtgtgtgtttatagtcttcaatgtatgttaacatgttaggaactgagtatcttaagagatgtcttagaatgctttagttttcataatttgtcctttatgtatttttcattgtatttgctgttttgacatggaagtaatttaaaaagttggtgcaggaaaggactctttactgttgcacattttggttttctgatatgtaataaattcatggcttggcagctgacatgatgtttcccagagagaaggagatgtatttctgcagggtccagaccaaaagagccatttacagcatgttctcccatgttccattatcagcctgatgaaacctgccctgccaaggcataaacttttgtactagctgtctccatattatgttcaataaattctgtgctctgaatatatttaaa

SEQ ID NO: 198846 - DNA, 937 bp, Homo sapiens
  Payload ID: 19226
  Gene Name: VAMP (vesicle-associated membrane protein)-associated protein B and C
  ENST ID: ENST00000520497
  CDS Start-End: 95-310
tttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgcatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcatttt

SEQ ID NO: 198847 - DNA, 2265 bp, Homo sapiens
  Payload ID: 19227
  Gene Name: VANGL planar cell polarity protein 1
  Uniprot ID: Q8TAA9
  ENST ID: ENST00000310260
  CDS Start-End: 216-1790
ctcgctcacaaaaaattgagccggccctggaggcctggggggcgagtccggttgcgcctcggagagcgcaacaggcagaatttgttcctgttgaagagtggctcctcttctaatttccagactccttgaggttttaggagtctggtaggtgaaattttctacctctaaggagaaacagtacctgctccttcctcaagcgcaagccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagttcaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagt

SEQ ID NO: 198848 - DNA, 8691 bp, Homo sapiens
  Payload ID: 19227
  Gene Name: VANGL planar cell polarity protein 1
  Uniprot ID: Q8TAA9
  ENST ID: ENST00000355485
  CDS Start-End: 272-1846
aggaagcggaaagcagcagtgcagcggcggcggcggcggggctctgcctctccaggagcccagcgcaggccgcagagccggggccgctgtgagccgagaccgcgggccgcggagctcgggcggccggcgcggagaatttgttcctgttgaagagtggctcctcttctaatttccagactccttgaggttttaggagtctggtaggtgaaattttctacctctaaggagaaacagtacctgctccttcctcaagcgcaagccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagttcaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagtcgtgggcagttcaggagatacctgccttcatctttgttctttgttgccttaggttcttcagagaaagatcacaacaaaaaatgtacactgtcgtttacagctattaagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactctgggattggcaggtgcaacttggagccacttaatttcctggggacgtaagttcttcccaagcttagagcaagctgccctgccaaaggagaccaaaccatgccaaccacgctggcaactgctgctgtccagtccctgtgttttctgaccaccgtcactgtgcaactcatcgcctctgccacttaggaccaggaaagaggctggttttgctcccactcttagttgctgataaagtggggagaaggaaaatggacactctacagagtttggggaagggagagtagggagcccatcttgtccagaaagattcatctgtggtctgtctgttaaacacagctgatttcagtgggctttcccctggccctgggggagcagacactgactgggttgtgggcagaggagccatcctggcggagccctgctgcaggggagctccttcaggagccccatccggacctcttgcactgggctgcctttgcctccatttgccttcctgtatctgcaacaaaccttttaaaagtgttcactcttgctttttccagtatttcggtaatcagccatcttgctgtagtacaggatgacattgtcgaatgctctttgtatgtgtgcacacccccttactcccttactgcttcatacactccacaagtggtacagtattttgtgtcattgtaaaaatcaaaattggctttggatctttgtaatacacctgtacctgaaaaagtaaacaacattcttcaattactagccttcagcttgaaaagacatgctggagaagaaggaagggggaacccataggtgtggcgtggagccaagatgtactattcaactatgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatatagttaataatgacactgttcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaagcctttgcactttcaacctctttatagcttgagttacttttgcagtgggaacaatgtaaatgacatttaaaagatttaaggtttcagaaagctgcatcccacaattgaacacaatgcatttttatttcaattcttggaactggtaggctattctttttaaaagggggtaaacttcgccctaaggctggtagaatgtatgttcacattatagtagacaggatttcatttgccttatatgtttatagattttttataattttcatcctacgttattaaaattagagcattgagtgttaaagaacttaatgaggagtctatatctgagattgctctcttccctggtgatgttttaactggtagataatttgttcttaaatatgtacttttgaagataggacagtttttatagtccatgaactgaatgttaaaaagttctgtatgcattctcagagaggattttaaagctatatagttcatccatcctttgcattatcaaaatgttaagtcaaatctgtaatactttggctaaaattcataaagtaagccctagagaaaatacttgaccaccaaatttttgcccaactatcatcacctcccttcccccgcctctgttcttgccttttgacatctacatggaagacaagttctttacagcaaatggtaagaggcaggtgacctggtgtgtttgctgtgttgtagttcattgcctggggcttgggactccttttttaatggagagactagctgtgcaggtgtgtgttggatagggataaagtgctcacccctgccctctctacagtagttggtggtagatttctctctcattttgcctcataatcactttcgagtgcatgtatttacctaagggctgtagctctgtgggatgctaccagcatattggactgacagaaattgattaccttgccactccaacctacgtactgagtgagtgctccagccactcagtgaaaccaacaaaagtgagtccttggtttaccttccaatctgggtcctgctgtgtaagtatccctaagtggggatgcatatttgtttgtgcgtttttatttccatatatgtgagcatttctctgagtgtattaccagacggatagcacatttatatgtcagacatcttaacatctgtgttatctgtagcaggtgtgtagctcagcagatacgtgtcattgtgtatatagctgagtgtgtgagggtgtctgtgtttctgcagtcccctgtgtttgagagatgacttaataaccctgtgttttgagaggtcgctctaaaccagtgacttttccctcccctgctttattcctttccctcactgacactggcttctcccgctagagtaaatggctttagcacagcactgtcttctggggagcctgctgtcctgcaggcaagtccattaaactctttcttgctttaggactctgaaaacagcaagaaacaaacaaacaaaggtcaagctctaagaaaattactgctcaaacttcactaccctggaagccttactagatatttcttaaggtaacttaaaaattgggctttatttttaaaaagtgataggttacttacagtagcacagaaatgttagcatatttatttaaatagtcctgcagcagagaccctgcgattgtaaagtgatttaagtatttctgggtagtgtttgtgatttacggatttgttactgaaaaacaaaaaaatcactactgtgaatttactactatgtaaccttgtggtcgtatttcattataaataaaataagaattgctcttctgcccaccgttcttgattggtattcagtgcagtagcgaaatgagatagtttagacactgttgaaataactgcattgagctttaaccaagtgtatgctcagaaaattcagttttggatcacattttgacaaaacatgttttggtcaaagaaaggaaaggctactaacacatttatcaggtaatgtatgtcacagtccgtgttccacccagccttgttatccccacattctttcaagataggagtcatcttggtttttcgggtgaaaaacggaaggtcagagaggaaggggcttgtccaaggtctcatgtctggttaacagaatttcaaactagatgtttgattctaacccctcagtccactgtaccttgaagtatggtctaaatgattcggcacttctggatgttgaggaaggacctagagacacatccttgaactagaacctggggtgagagttcattgggaggcaggatctcttctttcactttggatttacaccttgtcccttggaaagcttctccactatgctagcaaatatcttaggatatttgatggaaagaacttgagaatcccttctggaaaacccagcctttcagtgttaacacctgctgcaagacagggatgctgttgttctggcagcccccctttgcttttgcctggccccaccttctgctcccactctgctggcttgggcaagatgcgtgccttgggccttgggtgcagggaggcaggcaggggcttgacctggcctctctctggtgccatggcaacattatgccccaaacttcttccctggttggagtgagaggggctgtccacagccccatcctgtggggatctcaagccggagtccctggcctggcctccttgacgtaggtgttctcagcaagcagtttgcatcccaccgtctttctcacacttgcccccaagacttttgacagagcagacgtaaaacaggactcagaaaaccatttttctctgttcccatatgtagtaagttttgattcagttgtgcataaaccatagttttctgccctgctgtttgctttcaatggaagacagtaaagggaagatggtgctcacatctctccatgtgacatctcattaggaattaagatgcgatggattagaaatgtaaaacttcagaataaaattaaatttcagggctctataagtcccgttttcccaggtcctgttccgtttctacgtagataacccaatttgttttgtctatgaaataagcctctttagtgggttgttttagtctctccaacaaaagagcagattcctaaagccaggtgcagcactgtgaaaagtttctttcaatatggcaccaagactctaccatttatgtctctctcagcttacaaacatcagcgttttgtccttgtcatagtggaagaaagacacttactttaagctttggggacaaaggtgacaaaccccaggcttttatcttaaaagtgtctttggcacttcttttggcactgaaatggtatttgggaagcattatttgaatgtacagttgtttggttttgtatgtgcttatctttatctgagctttcacttgtagacatggccttttgttgtgaagttgctcatcatttaggagtgtttaattctaaaaagccttcagcctaagaaagcttcatctgtggggaccagagacttgttgctcagggagttagtgatgggacttgggcatctgatctgcaggtgacaagtttagttcaactgaagttgtagggaatttagacagttgcacatcattgccgttctaggggccttgtagaaagatgaaacagttgtttttcatttaccagcacctctcagttatagaggtaatggaacattcgcttacttttcatcatcattctttaaaaagggaacatacaaaaatctaaactatggcaataatttatttttataatagtttacggtaggctttaattaaatggcaaactcctctgggacccctaagttatggcgtgattagccaaatttgatttccaacagtcatttatggccataactattgcatagagtgcaggatgccagcaaagatgagggtgggggcagatactggctcagtgatttaactcacattatagatgaccccttcctcaacagaaatgctactgagagaaccagagaggcctgggccaggcaggtcttatttgagaggagattatttgataattgctttggttagaaggactttacatttcctgatttcaagtccagcaccaatttagaaagttcagagatgaaaccacctgtctttacctgacagagtcataacggtttgtgtaaaaatgtggtcagggaccttttttgttctttctgattagttaatactgtacattgtaaccaggaggggcagttttgccaaccagcctctgctcatggtcaccatatgtgtatgacaaggcctgagtgagttcctgcataaactgggtagtgggctcttttgacacatttgcaagcatgtaaatgaatgaatgacactaccagcaaccatctgtacaggtccatttacttacattcataaggtttatgctatgaaacttcttctcattgtgatgtcagtaacagagttagtgtctctgatggaatagtgtacctgtcacccaagttattttgttcctttttgggtcctccagtataatccccccctcatcccaattaactgtaaaatgttttacacatcacattttttatactgtaaacttggaaaataaactgaaatatcaaattg

SEQ ID NO: 198849 - DNA, 2062 bp, Homo sapiens
  Payload ID: 19227
  Gene Name: VANGL planar cell polarity protein 1
  Uniprot ID: Q8TAA9
  ENST ID: ENST00000369509
  CDS Start-End: 13-1587
ccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagttcaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagt

SEQ ID NO: 198850 - DNA, 8647 bp, Homo sapiens
  Payload ID: 19227
  Gene Name: VANGL planar cell polarity protein 1
  Uniprot ID: Q8TAA9
  ENST ID: ENST00000369510
  CDS Start-End: 234-1802
gggctctgcctctccaggagcccagcgcaggccgcagagccggggccgctgtgagccgagaccgcgggccgcggagctcgggcggccggcgcggagaatttgttcctgttgaagagtggctcctcttctaatttccagactccttgaggttttaggagtctggtaggtgaaattttctacctctaaggagaaacagtacctgctccttcctcaagcgcaagccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagtcgtgggcagttcaggagatacctgccttcatctttgttctttgttgccttaggttcttcagagaaagatcacaacaaaaaatgtacactgtcgtttacagctattaagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactctgggattggcaggtgcaacttggagccacttaatttcctggggacgtaagttcttcccaagcttagagcaagctgccctgccaaaggagaccaaaccatgccaaccacgctggcaactgctgctgtccagtccctgtgttttctgaccaccgtcactgtgcaactcatcgcctctgccacttaggaccaggaaagaggctggttttgctcccactcttagttgctgataaagtggggagaaggaaaatggacactctacagagtttggggaagggagagtagggagcccatcttgtccagaaagattcatctgtggtctgtctgttaaacacagctgatttcagtgggctttcccctggccctgggggagcagacactgactgggttgtgggcagaggagccatcctggcggagccctgctgcaggggagctccttcaggagccccatccggacctcttgcactgggctgcctttgcctccatttgccttcctgtatctgcaacaaaccttttaaaagtgttcactcttgctttttccagtatttcggtaatcagccatcttgctgtagtacaggatgacattgtcgaatgctctttgtatgtgtgcacacccccttactcccttactgcttcatacactccacaagtggtacagtattttgtgtcattgtaaaaatcaaaattggctttggatctttgtaatacacctgtacctgaaaaagtaaacaacattcttcaattactagccttcagcttgaaaagacatgctggagaagaaggaagggggaacccataggtgtggcgtggagccaagatgtactattcaactatgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatatagttaataatgacactgttcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaagcctttgcactttcaacctctttatagcttgagttacttttgcagtgggaacaatgtaaatgacatttaaaagatttaaggtttcagaaagctgcatcccacaattgaacacaatgcatttttatttcaattcttggaactggtaggctattctttttaaaagggggtaaacttcgccctaaggctggtagaatgtatgttcacattatagtagacaggatttcatttgccttatatgtttatagattttttataattttcatcctacgttattaaaattagagcattgagtgttaaagaacttaatgaggagtctatatctgagattgctctcttccctggtgatgttttaactggtagataatttgttcttaaatatgtacttttgaagataggacagtttttatagtccatgaactgaatgttaaaaagttctgtatgcattctcagagaggattttaaagctatatagttcatccatcctttgcattatcaaaatgttaagtcaaatctgtaatactttggctaaaattcataaagtaagccctagagaaaatacttgaccaccaaatttttgcccaactatcatcacctcccttcccccgcctctgttcttgccttttgacatctacatggaagacaagttctttacagcaaatggtaagaggcaggtgacctggtgtgtttgctgtgttgtagttcattgcctggggcttgggactccttttttaatggagagactagctgtgcaggtgtgtgttggatagggataaagtgctcacccctgccctctctacagtagttggtggtagatttctctctcattttgcctcataatcactttcgagtgcatgtatttacctaagggctgtagctctgtgggatgctaccagcatattggactgacagaaattgattaccttgccactccaacctacgtactgagtgagtgctccagccactcagtgaaaccaacaaaagtgagtccttggtttaccttccaatctgggtcctgctgtgtaagtatccctaagtggggatgcatatttgtttgtgcgtttttatttccatatatgtgagcatttctctgagtgtattaccagacggatagcacatttatatgtcagacatcttaacatctgtgttatctgtagcaggtgtgtagctcagcagatacgtgtcattgtgtatatagctgagtgtgtgagggtgtctgtgtttctgcagtcccctgtgtttgagagatgacttaataaccctgtgttttgagaggtcgctctaaaccagtgacttttccctcccctgctttattcctttccctcactgacactggcttctcccgctagagtaaatggctttagcacagcactgtcttctggggagcctgctgtcctgcaggcaagtccattaaactctttcttgctttaggactctgaaaacagcaagaaacaaacaaacaaaggtcaagctctaagaaaattactgctcaaacttcactaccctggaagccttactagatatttcttaaggtaacttaaaaattgggctttatttttaaaaagtgataggttacttacagtagcacagaaatgttagcatatttatttaaatagtcctgcagcagagaccctgcgattgtaaagtgatttaagtatttctgggtagtgtttgtgatttacggatttgttactgaaaaacaaaaaaatcactactgtgaatttactactatgtaaccttgtggtcgtatttcattataaataaaataagaattgctcttctgcccaccgttcttgattggtattcagtgcagtagcgaaatgagatagtttagacactgttgaaataactgcattgagctttaaccaagtgtatgctcagaaaattcagttttggatcacattttgacaaaacatgttttggtcaaagaaaggaaaggctactaacacatttatcaggtaatgtatgtcacagtccgtgttccacccagccttgttatccccacattctttcaagataggagtcatcttggtttttcgggtgaaaaacggaaggtcagagaggaaggggcttgtccaaggtctcatgtctggttaacagaatttcaaactagatgtttgattctaacccctcagtccactgtaccttgaagtatggtctaaatgattcggcacttctggatgttgaggaaggacctagagacacatccttgaactagaacctggggtgagagttcattgggaggcaggatctcttctttcactttggatttacaccttgtcccttggaaagcttctccactatgctagcaaatatcttaggatatttgatggaaagaacttgagaatcccttctggaaaacccagcctttcagtgttaacacctgctgcaagacagggatgctgttgttctggcagcccccctttgcttttgcctggccccaccttctgctcccactctgctggcttgggcaagatgcgtgccttgggccttgggtgcagggaggcaggcaggggcttgacctggcctctctctggtgccatggcaacattatgccccaaacttcttccctggttggagtgagaggggctgtccacagccccatcctgtggggatctcaagccggagtccctggcctggcctccttgacgtaggtgttctcagcaagcagtttgcatcccaccgtctttctcacacttgcccccaagacttttgacagagcagacgtaaaacaggactcagaaaaccatttttctctgttcccatatgtagtaagttttgattcagttgtgcataaaccatagttttctgccctgctgtttgctttcaatggaagacagtaaagggaagatggtgctcacatctctccatgtgacatctcattaggaattaagatgcgatggattagaaatgtaaaacttcagaataaaattaaatttcagggctctataagtcccgttttcccaggtcctgttccgtttctacgtagataacccaatttgttttgtctatgaaataagcctctttagtgggttgttttagtctctccaacaaaagagcagattcctaaagccaggtgcagcactgtgaaaagtttctttcaatatggcaccaagactctaccatttatgtctctctcagcttacaaacatcagcgttttgtccttgtcatagtggaagaaagacacttactttaagctttggggacaaaggtgacaaaccccaggcttttatcttaaaagtgtctttggcacttcttttggcactgaaatggtatttgggaagcattatttgaatgtacagttgtttggttttgtatgtgcttatctttatctgagctttcacttgtagacatggccttttgttgtgaagttgctcatcatttaggagtgtttaattctaaaaagccttcagcctaagaaagcttcatctgtggggaccagagacttgttgctcagggagttagtgatgggacttgggcatctgatctgcaggtgacaagtttagttcaactgaagttgtagggaatttagacagttgcacatcattgccgttctaggggccttgtagaaagatgaaacagttgtttttcatttaccagcacctctcagttatagaggtaatggaacattcgcttacttttcatcatcattctttaaaaagggaacatacaaaaatctaaactatggcaataatttatttttataatagtttacggtaggctttaattaaatggcaaactcctctgggacccctaagttatggcgtgattagccaaatttgatttccaacagtcatttatggccataactattgcatagagtgcaggatgccagcaaagatgagggtgggggcagatactggctcagtgatttaactcacattatagatgaccccttcctcaacagaaatgctactgagagaaccagagaggcctgggccaggcaggtcttatttgagaggagattatttgataattgctttggttagaaggactttacatttcctgatttcaagtccagcaccaatttagaaagttcagagatgaaaccacctgtctttacctgacagagtcataacggtttgtgtaaaaatgtggtcagggaccttttttgttctttctgattagttaatactgtacattgtaaccaggaggggcagttttgccaaccagcctctgctcatggtcaccatatgtgtatgacaaggcctgagtgagttcctgcataaactgggtagtgggctcttttgacacatttgcaagcatgtaaatgaatgaatgacactaccagcaaccatctgtacaggtccatttacttacattcataaggtttatgctatgaaacttcttctcattgtgatgtcagtaacagagttagtgtctctgatggaatagtgtacctgtcacccaagttattttgttcctttttgggtcctccagtataatccccccctcatcccaattaactgtaaaatgttttacacatcacattttttatactgtaaacttggaaaataaactgaaatatcaaattg

SEQ ID NO: 198851 - DNA, 5340 bp, Homo sapiens
  Payload ID: 19228
  Gene Name: VANGL planar cell polarity protein 2
  Uniprot ID: Q9ULK5
  ENST ID: ENST00000368061
  CDS Start-End: 475-2040
gattcctgatccttgattccttgatccttggtcccgccatgggagcctgagcgccccctattcccccctggcccccagcccccggggccttgagggggaagaggcagcggtctgggacggagcagggggtgaccagactcaagaacccccccctcaacatcccccatcgcgcgcgctgcctgtccaggagcgccgagttcggagcgacccggagcgctgcggatacaaaggcgacgggccgagcggggcgcccgcggagcccacccggcagttcgcagcggcgggagcgtcgctggattttctctgagacaagcccacccgtccagcaaaatagagtccctcagggtgacagttgacttcctgaaggtgcctcttggcctaaagaagccggtgctgaaggaggtggctgtggggccccccaagaggccccagcctgcggccctggagcgctacaaggcgcggcgttcagacgccatggacaccgagtcccagtactcgggctattcctacaagtcgggccactcccgcagctcccgcaagcacagggaccgccgggaccgacaccgctctaagagtcgagatgggggccgaggggacaagtcggtgacaatccaggctcccggggagcccctgctggacaatgagtccacacgaggggatgagcgggatgacaactggggggaaacgacgacagtagtaacgggcacctcagagcacagcatctcccatgatgacctcacacgcatcgccaaggacatggaggacagtgtccctctggactgctcccgtcacctgggtgtggcagcgggggccaccctggcactgctgtctttcctcacgcctctggccttcctgctgctgcccccactgctgtggcgggaggagctggagccttgcgggacggcctgcgagggcctcttcatctctgtcgccttcaagctgctcatcctgctactgggcagctgggctctgttcttccgccggcccaaggcctcgctgccccgcgtctttgtgctgcgtgccctgcttatggtgctggttttcctgctcgtggtctcctactggctcttctatggtgtgcgcatcctggatgctcgggagcgcagctaccagggcgtggtgcagttcgccgtgtcgctggtggacgcccttcttttcgtgcactacctggccgtggtcctgctggagctgcgccagctccagcctcagttcacgctcaaggtcgtgcgctccaccgacggcgccagccgcttctacaacgttggccatctcagcatccagcgcgtggcagtgtggatcctggagaagtattaccatgacttccctgtctacaaccctgccctcctcaacctgcccaagtccgtcctggccaagaaagtgtctggcttcaaggtgtattccctcggagaggaaaacagcaccaacaactccactggccagtctcgggctgtgattgcagcggcagctcggaggcgggacaacagtcacaatgagtactactatgaggaggctgagcatgagcgaagggtgcgcaagaggagggccaggcttgtagtggcggtggaggaggccttcactcacattaagcggctgcaggaagaggagcagaaaaaccccagggaggtgatggacccccgggaggcagcccaagccatctttgcatccatggcccgtgccatgcagaagtaccttcggaccaccaagcagcagccctaccacaccatggagagcatcctgcagcaccttgaattctgcatcacgcatgacatgacgcccaaggccttcttggagcgatacttggcggctggacctaccatccagtaccacaaggaacgctggctggccaaacagtggacattggtgagcgaggagccggtgaccaacggcctcaaggatggcatcgttttcctcttaaaacgccaggacttcagcctggtggtcagcaccaagaaggtcccattcttcaaactctccgaggaatttgtggatcccaagtcacacaagtttgtcatgaggctgcagtctgagacctcagtgtgactgtgcaacagcagggggagtgggaaactctggggggtcctgagggggtgggagggggcttggttctcaggcccagccacattcctgccacccttcttcttcttgctcttttttttttacttgaattaacgcacccccaccttctctcctcgcttcttccttattttaccccatgtgaacctggagagaccatcctgctgtcaacagtacctgggaaggactcccacctcaccaacaacttttgtattactctaggccctgcaggaatcagtgcctctctccctcttctttccctagtcttttcccagattacagtctctcctgaaagggcacagggccctgctgattgtactttcccctcctgagccccgactcacaaatccaagttcttaaaacatttctcttcagtggcccaacagggtttctctggggcacatggacatgactccagagagccacagtgccaaactcctccagggcagcaactggccctcctgtccctcaccccagccacaacaaaccctgggttctagggcagggatactcctgccacacagcccgagttagaaatctccttgctaggagcatttgcttccacatatatttagagcaaagaaggatcccatccttttcccagaaatctccacctaatgtttttggtttgtatggtcacgtgaccataggcaaccacgtggaaaccctctgtgaccacttttccagggacttaggggaaggtacctttcttccaatgtgtcttcctaggcagcccctgaggaggagggctgaatagatccctgaggttttggagagacccccatcactgactcctgctccctaaccctaccctcactttcgtccccgctcttcccagtgaaggatggtatgtagactcctgtacagacatagtggcttgcagaccctgacccagcccctgtggtcttagacaaatgtttttatttttgtcaccagccacccctgtcctgccgccttctctcgactccagagacctgttgcctcatctcttttggggaagagccggcagctcctcctcatcccctgccttaagtccagttctttgcctcaggggtctcgtttccttggccttccagggtccccaccccttttctccctgcctgattctctgagctctgggctccgtctgtattgggttgaggggcaaggattactgccttttgtaggtacttcacccctcaccccattttagcttccatagtctttgcaccaaatccaaattcttgataatttagatctcattttgagcaaaatttgctggccctctaataaatattttcaatataaatctgagcctttgactcagacatttttgccaaggagagtagaattaggaagtacccatatacatccagccaggatccacatggaggacctttctgatggctgcaatgactaggccattcctctgagtaactcacagtgtccttttgtaggcccttcttttccctgaaagactggttggtacttaccttgcagagcacatcctgggataagatccccagtgtctcccctgggaggctccccctctgtgtagcaccagccctgggaatgatggagcctagtgatcggggtttctcctgctgtcctttctgcaaaagttcacttgtttacccaccgcatgctagagaggagctcattggccaatgcttaccttgtccccaaaggggtgggttgtggagctcacttaggcagggcctctggctggggccagggttatgagataggcctgtatgaaatatgtcctgttctgggggtctgtctcttttcttctcttcaaaaactttgtgtcagagagtcccttctgagtcacataaatacctcactatcctggaaaacagggcctggatggtgactggggtcattgcctttgtggacaggatggagtgtggtgtggtctgaggagcaggttggggtgggggagagggaaaggatttgggatcttagttgctgccctaggttaggggctggggagtgtttattttaagatcctgccatgtttttaatcactgtgatttttttttcattcccctttcctaaaaaaaattttttgcctccaactctctaagcactaagggctgtgcctgagaatggtagcattttggtcttttgcttcagaactgtggtatctttgtcttttttcattattattattattattattattattattactattgttttttaaaatgtcaggatgaattgtcagacatatggccatgtgtttgtcctctgcttctcccctgtgggaagttgtctccatgctgtgaactgctgtggggtgtgcagctgactcagtccctctgagcagtttccccactgtgtctgtcccatcatgcgctggatctgctcattctcctgctgtgggggtatgcccacctcttacccccttgacaccatagggctgctgtggctgggcctcaccagcactgtcttttgtgtgactcatggcatcctcgttcatccccaccgtgcctagcaggccttccttttcaccacctcggaacgcttgcctttcctccctccacaacaggacgctgtgcctcagtccttcacctacctcgccactctgccactgtccccattggtcctttctcctaaactggtctttgtgctctctttgttttttcttatttccctcttgtctctcattttttcttcccattcccctcccatttcagcccttaacttttctctttcccatctccactcagtattccaatggcaaaccctgatgatgtaacacctgcgatgagacatcggactctccggaactttctcatctgacacgtctttttcccagggttcgtacttctcctccattggtcccaggctaactcccctgttcctctgtggtgtctgtcagtccgtctgtcttctctttcctctgcccttcccacagggcagtatctgctgatggattcagtcctggtgtgtgattgttgtgatttgttcttccgtgcgcaaaaggaagagggctttttgagtcccttccaagtgagattgtaaatgtagaattttccactgttggatctagattttttttccttttttttgggggggtggggttacagagctgagaccttgtgcatgcatgtagaaaattgtaaaatgtaaattttttttaatatataaaaagcttgtttctacagtttgcagtggatctaaacattacggcaattttaggatttttttcttaaacataggaactaaaactgtacaaattttttttatataaaataaagacatttgacttttgtgggggca

SEQ ID NO: 198852 - DNA, 3106 bp, Homo sapiens
  Payload ID: 19229
  Gene Name: vanin 1
  Uniprot ID: O95497
  ENST ID: ENST00000367928
  CDS Start-End: 15-1556
cattggacttcagcatgactactcagttgccagcttacgtggcaattttgcttttctatgtctcaagagccagctgccaggacactttcactgcagctgtttatgagcatgcagcgatattgcccaatgccaccctaacaccagtgtctcgtgaggaggctttggcattaatgaatcggaatctggacattttggaaggagcgatcacatcagcagcagatcagggtgcgcatattattgtgactccagaagatgctatttatggctggaacttcaacagggactctctctacccatatttggaggacatcccagaccctgaagtaaactggatcccctgtaataatcgtaacagatttggccagaccccagtacaagaaagactcagctgcctggccaagaacaactctatctatgttgtggcaaatattggggacaagaagccatgcgataccagtgatcctcagtgtccccctgatggccgttaccaatacaacactgatgtggtatttgattctcaaggaaaactggtggcacgctaccataagcaaaaccttttcatgggtgaaaatcaattcaatgtacccaaggagcctgagattgtgactttcaataccacctttggaagttttggcattttcacatgctttgatatactcttccatgatcctgctgttaccttggtgaaagatttccacgtggacaccatagtattcccaacagcttggatgaatgttttgccacatttgtcagctgttgaattccactcagcttgggctatgggcatgagggtcaatttccttgcatccaacatacattacccctcaaagaaaatgacaggaagtggcatctatgcacccaattcttcaagagcatttcattatgatatgaagacagaagagggaaaactcctcctctcgcaactggattcccacccatcccattctgcagtggtgaactggacttcctatgccagcagtatagaagcgctctcatcaggaaacaaggaatttaaaggcactgtctttttcgatgaattcacttttgtgaagctcacaggagttgcaggaaattatacagtttgtcagaaagatctctgctgtcatttaagctacaaaatgtctgagaacataccaaatgaagtgtacgctctaggggcatttgacggactgcacactgtggaagggcgctattatctacagatttgtaccctgttgaaatgtaaaacgactaatttaaacacttgcggtgactcagctgaaacagcttctaccaggtttgaaatgttctccctcagtggcactttcggaacccagtatgtctttcctgaggtgttgctgagtgaaaatcagcttgcacctggagaatttcaggtgtcaactgacggacgcttgtttagtctgaagccaacatccggacctgtcttaacagtaactctgtttgggaggttgtatgagaaggactgggcatcaaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaaaaaactatatttgaacattggtctttcttggacgtgagctaattatatcaaataagtatcacaaatcttttacgcagaagaaataaaaactacgggtagaaaacataagaactatcataaaatttacttacaaggaggctgctcttgttaccacttttattatattacgtatcacttattcagctctgctgaaaatttccaatgactttgtttgtttgctctttttgttttttacctaaacaatacattttgattctcttgtgggttgataatgtctccccaaaatttacatgttgaagcacctcagaatgtgactgtatttggagacagggtctttaaagaggtaaaataaggtcattaggatagaccctaattcaatatgactgatgatcataaaagaagaggcgagtagggcacaacaggcacaaagggagaccataaggagacacagaggaaggacaactctttacaagctaagaagagagggcctcagaagaaaccaaccctgccaacaccttgatcttggacttccagcctccaaaactatgagaaataaatttctattgtttaagtcacccagtccatggtactttgttaggcagccctggcaaatgaatcaaagacccattcctgttcctctccccaccactactgttttctactgtaatctgaagcttcaacaaaaggcttacctggtaagaatattcagctggtctgggtcctcaagactccaatagacactcttagagaaggattgctgatggattgatagtgaaaccattagatcattgaattcctctggaattagaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaaca

SEQ ID NO: 198853 - DNA, 2118 bp, Homo sapiens
  Payload ID: 19230
  Gene Name: vanin 2
  Uniprot ID: O95498
  ENST ID: ENST00000326499
  CDS Start-End: 126-1688
aagaagaaaaatgatgataaagtaaaaggccagtaactggcagccacatgttatgcaaacattctcccctctgtaaatactacatgaatgttatttttgctttcagaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattca

SEQ ID NO: 198854 - DNA, 1920 bp, Homo sapiens
  Payload ID: 19230
  Gene Name: vanin 2
  ENST ID: ENST00000392389
  CDS Start-End: 88-960
ggcagccacatgttatgcaaacattctcccctctgtaaatactacatgaatgttatttttgctttcagaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttg

SEQ ID NO: 198855 - DNA, 1781 bp, Homo sapiens
  Payload ID: 19230
  Gene Name: vanin 2
  ENST ID: ENST00000418593
  CDS Start-End: 1-660
atggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattca

SEQ ID NO: 198856 - DNA, 1873 bp, Homo sapiens
  Payload ID: 19230
  Gene Name: vanin 2
  ENST ID: ENST00000422400
  CDS Start-End: 1-651
atggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctt

SEQ ID NO: 198857 - DNA, 594 bp, Homo sapiens
  Payload ID: 19230
  Gene Name: vanin 2
  ENST ID: ENST00000524919
  CDS Start-End: 97-594
gactggaggagcacaggccttggaaaggaaagcagctgagatccagaggagtggaaggctcccccttgactaaagctaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtg

SEQ ID NO: 198858 - DNA, 543 bp, Homo sapiens
  Payload ID: 19230
  Gene Name: vanin 2
  ENST ID: ENST00000532012
  CDS Start-End: 241-543
aaagcagctgagatccagaggagtggaaggctcccccttgactaaagctccaaggacagagaaaaacatccagatttgggaacacaataacagatatgattgtccccacttctactgccaaaattataaaactgttaactcctcctcatcagcttacctgactacttaaaagcaaaagagttaattaagtattactaattggtgatactagatcaatgaagaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatccca

SEQ ID NO: 198859 - DNA, 1123 bp, Homo sapiens
  Payload ID: 19230
  Gene Name: vanin 2
  ENST ID: ENST00000533835
  CDS Start-End: 22-576
agaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataaggtgggcaagagtcactgagattactttggatgggacactaaagagagagatgacatctctcacctgacttacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtat

SEQ ID NO: 198860 - DNA, 571 bp, Homo sapiens
  Payload ID: 19230
  Gene Name: vanin 2
  ENST ID: ENST00000531279
  CDS Start-End: 84-479
aagcagctgagatccagaggagtggaaggctcccccttgactaaagctaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataaggtgggcaagagtcactgagattactttggatgggacactaaagagagagatgacatctctcacctgacttacagtaccacctgtactctgagcctcagtttaatgtccct

SEQ ID NO: 198861 - DNA, 707 bp, Homo sapiens
  Payload ID: 19230
  Gene Name: vanin 2
  ENST ID: ENST00000528801
  CDS Start-End: 1-360
atggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatag

SEQ ID NO: 198862 - DNA, 1034 bp, Homo sapiens
  Payload ID: 19230
  Gene Name: vanin 2
  Uniprot ID: O95498
  ENST ID: ENST00000532053
  CDS Start-End: 1-579
atggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatag

SEQ ID NO: 198863 - DNA, 587 bp, Homo sapiens
  Payload ID: 19230
  Gene Name: vanin 2
  ENST ID: ENST00000530536
  CDS Start-End: 281-587
ggaggagcacaggccttggaaaggaaagcagctgagatccagaggagtggaaggctcccccttgactaaagctccaaggacagagaaaaacatccagatttgggaacacaataacagatatgattgtccccacttctactgccaaaattataaaactgttaactcctcctcatcagcttacctgactacttaaaagcaaaagagttaattaagtattactaattggtgatactagatcaatgaagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctccta

SEQ ID NO: 198864 - DNA, 1608 bp, Homo sapiens
  Payload ID: 19230
  Gene Name: vanin 2
  Uniprot ID: O95498
  ENST ID: ENST00000525270
  CDS Start-End: 101-1504
acaggccttggaaaggaaagcagctgagatccagaggagtggaaggctcccccttgactaaagctaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtata

SEQ ID NO: 198865 - DNA, 1274 bp, Homo sapiens
  Payload ID: 19230
  Gene Name: vanin 2
  Uniprot ID: O95498
  ENST ID: ENST00000525674
  CDS Start-End: 1-588
atggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatag

SEQ ID NO: 198866 - DNA, 900 bp, Homo sapiens
  Payload ID: 19230
  Gene Name: vanin 2
  Uniprot ID: O95498
  ENST ID: ENST00000525289
  CDS Start-End: 1-900
atggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatag

SEQ ID NO: 198867 - DNA, 1717 bp, Homo sapiens
  Payload ID: 19231
  Gene Name: vanin 3
  Uniprot ID: Q9NY84
  ENST ID: ENST00000367927
  CDS Start-End: 74-898
aatgtaaagtttttccagtgaaacaaaacgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagtacaatctttttgcacctgaaattcagtttgatttccccaaggattcagaacttgtgacttttgacactccctttgggaagtttggcatttttacttgctttgacattttttctcatgacccagctgtggtggtggtggatgagtttcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagcaa

SEQ ID NO: 198868 - DNA, 1377 bp, Homo sapiens
  Payload ID: 19231
  Gene Name: vanin 3
  Uniprot ID: Q9NY84
  ENST ID: ENST00000519686
  CDS Start-End: 1-354
atgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagaaatcactaaaatatagtaagtttgaggaaatgtctattgaattagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtga

SEQ ID NO: 198869 - DNA, 1761 bp, Homo sapiens
  Payload ID: 19231
  Gene Name: vanin 3
  Uniprot ID: Q9NY84
  ENST ID: ENST00000425515
  CDS Start-End: 74-427
aatgtaaagtttttccagtgaaacaaaacgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagaaatcactaaaatatagtaagtttgaggaaatgtctattgaattagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagtacaatctttttgcacctgaaattcagtttgatttccccaaggattcagaacttgtgacttttgacactccctttgggaagtttggcatttttacttgctttgacattttttctcatgacccagctgtggtggtggtggatgagtttcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagc

SEQ ID NO: 198870 - DNA, 492 bp, Homo sapiens
  Payload ID: 19231
  Gene Name: vanin 3
  ENST ID: ENST00000544102
  CDS Start-End: 1-181
caccagggagagcatttacccctatctagaggatataccagaccctggagtgaactggattccatgtagagacccctggaggaagagtaaaaagatgaatgagcctgtttccaaagagctttgctatcactgtcattcagaatgcaatcaatatggccaatggaaattgtataggacttgaaaaaggaagccctacttctgggaccacattttacgaccacctagctgagtgataaatcactaaaatatagtaagtttgaggaaatgtctattgaattagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagtacaatctttttgcacctg

SEQ ID NO: 198871 - DNA, 596 bp, Homo sapiens
  Payload ID: 19231
  Gene Name: vanin 3
  ENST ID: ENST00000450865
  CDS Start-End: 74-583
aatgtaaagtttttccagtgaaacaaaacgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagcagggtgcacatatcattgtgaccccagaagatggaatctatggttggatcttcaccagggagagcatttacccctatctagaggatataccagaccctggagtgaactggattccatgtagagacccctggagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagag

SEQ ID NO: 198872 - DNA, 1685 bp, Homo sapiens
  Payload ID: 19231
  Gene Name: vanin 3
  ENST ID: ENST00000207771
  CDS Start-End: 46-1548
cgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagtacaatctttttgcacctgaaattcagtttgatttccccaaggattcagaacttgtgacttttgacactccctttgggaagtttggcatttttacttgctttgacattttttctcatgacccagctgtggtggtggtggatgagtcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagc

SEQ ID NO: 198873 - DNA, 1603 bp, Homo sapiens
  Payload ID: 19231
  Gene Name: vanin 3
  Uniprot ID: Q9NY84
  ENST ID: ENST00000392393
  CDS Start-End: 74-517
aatgtaaagtttttccagtgaaacaaaacgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggaggaagagtaaaaagatgaatgagcctgtttccaaagagctttgctatcactgtcattcagaatgcaatcaatatggccaatggaaattgtataggacttgaaaaaggaagccctacttctgggaccacattttacgaccacctagctgagtgataaatcactaaaatatagtaagtttgaggaaatgtctattgaattagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtga

SEQ ID NO: 198874 - DNA, 1260 bp, Homo sapiens
  Payload ID: 19231
  Gene Name: vanin 3
  Uniprot ID: Q9NY84
  ENST ID: ENST00000275223
  CDS Start-End: 1-354
atgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagaaatcactaaaatatagtaagtttgaggaaatgtctattgaattagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtga

SEQ ID NO: 198875 - DNA, 1021 bp, Homo sapiens
  Payload ID: 19231
  Gene Name: vanin 3
  Uniprot ID: Q9NY84
  ENST ID: ENST00000423615
  CDS Start-End: 1-390
atgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtga

SEQ ID NO: 198876 - DNA, 1214 bp, Homo sapiens
  Payload ID: 19231
  Gene Name: vanin 3
  Uniprot ID: Q9NY84
  ENST ID: ENST00000427187
  CDS Start-End: 1-624
atgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtga

SEQ ID NO: 198877 - DNA, 1312 bp, Homo sapiens
  Payload ID: 19231
  Gene Name: vanin 3
  Uniprot ID: Q9NY84
  ENST ID: ENST00000414302
  CDS Start-End: 1-402
atgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagtacaatctttttgcacctgaaattcagtttgatttccccaaggattcagaacttgtgacttttgacactccctttgggaagtttggcatttttacttgctttgacattttttctcatgacccagctgtggtggtggtggatgagtttcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtga

SEQ ID NO: 198878 - DNA, 1117 bp, Homo sapiens
  Payload ID: 19231
  Gene Name: vanin 3
  Uniprot ID: Q9NY84
  ENST ID: ENST00000417437
  CDS Start-End: 1-486
atgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcaggtattacccttttatacttgtaaaggagacttgcagtttggtcaaagagtatttggaattcatgacaaacttttttgccccacttgtttcgagcagggtgcacatatcattgtgaccccagaagatggaatctatggttggatcttcaccagggagagcatttacccctatctagaggatataccagaccctggagtgaactggattccatgtagagacccctggagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtga

SEQ ID NO: 198879 - DNA, 1700 bp, Homo sapiens
  Payload ID: 19231
  Gene Name: vanin 3
  Uniprot ID: Q9NY84
  ENST ID: ENST00000509351
  CDS Start-End: 1-390
atgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgaggtaggaggtgtgcaggatgataaattcctttgagcagagtagatgggtagagcagcataatgaaaatctttgaaataatgagagtatagcaatatcgtggttcacattctacaagaaacaccttaaatatgtggaaactatgatatggaatataaattgtggttttagattgccattaggctgtgatggagaatttggggttcatttttttaacataaatgtgatgttgatattcaaggcaacaggaaattcacagagaagctaaaataaaaatgttgactgctgataatggcaataatgttgtcatttgcatggtgtagaaggtgcaaattaaatacattaaataatgcatctacaacttattttctgggtatactattttgagaagttgttataattatagtaataactaatattttgtatagtgtttcatgagtttgaagaacatatttttatacatattatttgaccacctgtgcaacaaatttgttggctgcactttcgcacaaagtccctctactttcagacttgaaacatgaacctgggtcttccaacaccaaatcctgtgtgatttttaccattctacactgctttaggagggagtgatcttgcctgagaagggctctaggttgtaacctaaactctgcactgaagttaaccctttgctttctttgaccagatttcaagagatggacgcttgaggagccgaagtggagcccctttgcctgtcttagttatggccctgtatggaagagtgtttgagaaggaccctccacgcttagggcagggatctgggaaattccagtga

SEQ ID NO: 198880 - DNA, 677 bp, Homo sapiens
  Payload ID: 19232
  Gene Name: variable charge, X-linked
  ENST ID: ENST00000341408
  CDS Start-End: 117-677
accaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtag

SEQ ID NO: 198881 - DNA, 967 bp, Homo sapiens
  Payload ID: 19232
  Gene Name: variable charge, X-linked
  Uniprot ID: Q9H320
  ENST ID: ENST00000381059
  CDS Start-End: 220-840
atgtggacactgggagaaggaagtgagatggaaaagttctttgattgcatccaagaagtgaatggtcctcaagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattga

SEQ ID NO: 198882 - DNA, 812 bp, Homo sapiens
  Payload ID: 19232
  Gene Name: variable charge, X-linked
  ENST ID: ENST00000620630
  CDS Start-End: 308-724
atgtggacactgggagaaggaagtgagatggaaaagttctttgattgcatccaagaagtgaatggtcctcaaggtgcagcagaggaatttgtaggagagagggatgattgacgtcttcatatagccctccgtctatcccagttagcatggagggattttagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtgtgacggccaagtactcccctatctccgagagcagcgactaagttcaggcccagccgccagacctcagagatctcaccagcggggtgcttgccattctgaagataataaaatgaatgtgttgcaaattga

SEQ ID NO: 198883 - DNA, 815 bp, Homo sapiens
  Payload ID: 19233
  Gene Name: variable charge, X-linked 2
  Uniprot ID: Q9H322
  ENST ID: ENST00000317103
  CDS Start-End: 308-727
atgtggatgctgggagaagtatgtgagatggaaaagttgtttcatggcatccaagaagtgaatgatcctcaaggtgtagcagaggaatttgtaggagagagggatgattgacgtcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggagagcgaggtggaagaaccactgagtcaggagagcgaggtggaagaaccactgactgtgtggatggccagcttttcccctgtctccgagagcaccgactaagttcaggcccagccgccagacctcagagatctcaccagcggggtgcttgccattctgaagataataaaatgaatgtgttgcaaattga

SEQ ID NO: 198884 - DNA, 995 bp, Homo sapiens
  Payload ID: 19234
  Gene Name: variable charge, X-linked 3A
  Uniprot ID: Q9NNX9
  ENST ID: ENST00000381089
  CDS Start-End: 308-868
atgtggatgctgggagaagtatgtgagatggaaaagttgtttcatggcatccaagaagtgaatgatcctcaaggtgtagcagaggaatctgtaggagagagggatgattgacgtcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaactaccgagtgtgtagacggccagctactcccctatctccgagagcagcgactaagttcaggcccagccgccagacctcagagatctcaccagcggggtgcttgccattctgaagataataaaatgaatgtgttgcaaattga

SEQ ID NO: 198885 - DNA, 808 bp, Homo sapiens
  Payload ID: 19234
  Gene Name: variable charge, X-linked 3A
  ENST ID: ENST00000398729
  CDS Start-End: 308-808
atgtggatgctgggagaagtatgtgagatggaaaagttgtttcatggcatccaagaagtgaatgatcctcaaggtgtagcagaggaatctgtaggagagagggatgattgacgtcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaactaccgagtgtgtag

SEQ ID NO: 198886 - DNA, 812 bp, Homo sapiens
  Payload ID: 19234
  Gene Name: variable charge, X-linked 3A
  ENST ID: ENST00000612369
  CDS Start-End: 308-724
atgtggatgctgggagaagtatgtgagatggaaaagttgtttcatggcatccaagaagtgaatgatcctcaaggtgtagcagaggaatctgtaggagagagggatgattgacgtcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtgtgacggccagctactcccctatctccgagagcagcgactaagttcaggcccagccgccagacctcagagatctcaccagcggggtgcttgccattctgaagataataaaatgaatgtgttgcaaattga

SEQ ID NO: 198887 - DNA, 756 bp, Homo sapiens
  Payload ID: 19235
  Gene Name: variable charge, X-linked 3B
  ENST ID: ENST00000381029
  CDS Start-End: 26-670
gttgcgagacgttgagctgcggaagatgagtccaaagccgagagcctcgggacctccggccaaggccaaggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggtggaagaaccactgagtcaggagagccaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccaagtactcccctatctccgagagcagcgactaagttcaggcccagccgccagacctcagagatctcaccagcggggtgct

SEQ ID NO: 198888 - DNA, 1171 bp, Homo sapiens
  Payload ID: 19235
  Gene Name: variable charge, X-linked 3B
  Uniprot ID: Q9H321
  ENST ID: ENST00000381032
  CDS Start-End: 308-1048
atgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccaagtactcccctatctccgagagcagcgactaagttcaggcccagccgccagacctcagagatctcaccagcggggtgcttgccattctgatgataataaaatgaatgtgttgcaaa

SEQ ID NO: 198889 - DNA, 868 bp, Homo sapiens
  Payload ID: 19235
  Gene Name: variable charge, X-linked 3B
  ENST ID: ENST00000453306
  CDS Start-End: 308-868
atgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagcgagatggaagaactaccgagtgtgtag

SEQ ID NO: 198890 - DNA, 812 bp, Homo sapiens
  Payload ID: 19235
  Gene Name: variable charge, X-linked 3B
  ENST ID: ENST00000444481
  CDS Start-End: 308-724
atgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtgtgacggccaagtactcccctatctccgagagcagcgactaagttcaggcccagccgccagacctcagagatctcaccagcggggtgcttgccattctgatgataataaaatgaatgtgttgcaaattga

SEQ ID NO: 198891 - DNA, 550 bp, Homo sapiens
  Payload ID: 19236
  Gene Name: variable charge, Y-linked
  Uniprot ID: O14598
  ENST ID: ENST00000250825
  CDS Start-End: 74-451
cgagaggggtatacacagggaggccaggcagcctggagttagtcgaccgttgcgagacgttgagctgcggcagatgagtccaaagccgagagcctcgggacctccggccaaggccaaggagacaggaaagaggaagtcctcctctcagccgagccccagtggcccgaagaagaagactaccaaggtggccgagaagggagaagcagttcgtggagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtaaggggcgcccatctactcccctatctccctgagcagcaactaagtttaggcccagctgccagacctcagagatctcaccagcagggtgcttcccatgttgatgacaataaaatgaatgtgttgcaaaccga

SEQ ID NO: 198892 - DNA, 550 bp, Homo sapiens; identical to SEQ ID NO: 198891
  Payload ID: 19237
  Gene Name: variable charge, Y-linked 1B
  Uniprot ID: O14598
  ENST ID: ENST00000250823
  CDS Start-End: 74-451

SEQ ID NO: 198893 - DNA, 3083 bp, Homo sapiens
  Payload ID: 19238
  Gene Name: vascular cell adhesion molecule 1
  Uniprot ID: P19320
  ENST ID: ENST00000294728
  CDS Start-End: 102-2321
ctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaa

SEQ ID NO: 198894 - DNA, 2812 bp, Homo sapiens
  Payload ID: 19238
  Gene Name: vascular cell adhesion molecule 1
  Uniprot ID: P19320
  ENST ID: ENST00000347652
  CDS Start-End: 107-2050
cgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaa

SEQ ID NO: 198895 - DNA, 2475 bp, Homo sapiens
  Payload ID: 19238
  Gene Name: vascular cell adhesion molecule 1
  ENST ID: ENST00000370115
  CDS Start-End: 98-1720
ctggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctgga

SEQ ID NO: 198896 - DNA, 2483 bp, Homo sapiens
  Payload ID: 19238
  Gene Name: vascular cell adhesion molecule 1
  Uniprot ID: P19320
  ENST ID: ENST00000370119
  CDS Start-End: 120-2153
gcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaa

SEQ ID NO: 198897 - DNA, 993 bp, Homo sapiens
  Payload ID: 19239
  Gene Name: vascular endothelial growth factor A
  ENST ID: ENST00000230480
  CDS Start-End: 129-620
gcctggccggccgcgtgttcccggagcctcggctgcccgaatggggagcccagagtggcgagcggcacccctccccccgccagccctccgcgggaaggtgacctctcgagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatat

SEQ ID NO: 198898 - DNA, 954 bp, Homo sapiens
  Payload ID: 19239
  Gene Name: vascular endothelial growth factor A
  ENST ID: ENST00000324450
  CDS Start-End: 1-954
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagatgtgacaagccgaggcggtga

SEQ ID NO: 198899 - DNA, 1286 bp, Homo sapiens
  Payload ID: 19239
  Gene Name: vascular endothelial growth factor A
  ENST ID: ENST00000372055
  CDS Start-End: 1-1239
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatc

SEQ ID NO: 198900 - DNA, 2909 bp, Homo sapiens
  Payload ID: 19239
  Gene Name: vascular endothelial growth factor A
  ENST ID: ENST00000372064
  CDS Start-End: 1-984
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 198901 - DNA, 3535 bp, Homo sapiens
  Payload ID: 19239
  Gene Name: vascular endothelial growth factor A
  ENST ID: ENST00000372067
  CDS Start-End: 495-1610
ggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 198902 - DNA, 2834 bp, Homo sapiens
  Payload ID: 19239
  Gene Name: vascular endothelial growth factor A
  Uniprot ID: P15692
  ENST ID: ENST00000372077
  CDS Start-End: 466-909
gcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 198903 - DNA, 1575 bp, Homo sapiens
  Payload ID: 19239
  Gene Name: vascular endothelial growth factor A
  ENST ID: ENST00000425836
  CDS Start-End: 1-1188
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaa

SEQ ID NO: 198904 - DNA, 1081 bp, Homo sapiens
  Payload ID: 19239
  Gene Name: vascular endothelial growth factor A
  ENST ID: ENST00000417285
  CDS Start-End: 1-1065
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaagatgtgacaagccgaggcggtga

SEQ ID NO: 198905 - DNA, 1197 bp, Homo sapiens
  Payload ID: 19239
  Gene Name: vascular endothelial growth factor A
  ENST ID: ENST00000413642
  CDS Start-End: 1-1170
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctc

SEQ ID NO: 198906 - DNA, 414 bp, Homo sapiens
  Payload ID: 19239
  Gene Name: vascular endothelial growth factor A
  Uniprot ID: P15692
  ENST ID: ENST00000457104
  CDS Start-End: 1-414
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagatgtgacaagccgaggcggtga

SEQ ID NO: 198907 - DNA, 1146 bp, Homo sapiens
  Payload ID: 19239
  Gene Name: vascular endothelial growth factor A
  ENST ID: ENST00000482630
  CDS Start-End: 1-1116
ctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatctctcaccaggaaagactgatacagaacgatcgatacagaaaccacgctg

SEQ ID NO: 198908 - DNA, 1199 bp, Homo sapiens
  Payload ID: 19239
  Gene Name: vascular endothelial growth factor A
  Uniprot ID: P15692
  ENST ID: ENST00000520948
  CDS Start-End: 165-812
gcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaa

SEQ ID NO: 198909 - DNA, 541 bp, Homo sapiens
  Payload ID: 19239
  Gene Name: vascular endothelial growth factor A
  Uniprot ID: P15692
  ENST ID: ENST00000523125
  CDS Start-End: 1-525
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaagatgtgacaagccgaggcggtga

SEQ ID NO: 198910 - DNA, 336 bp, Homo sapiens
  Payload ID: 19239
  Gene Name: vascular endothelial growth factor A
  ENST ID: ENST00000520265
  CDS Start-End: 1-336
gcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagacgtgtaaatgttcctgcaaaaacacagactcgcgttgcaaggcgaggcagcttgagttaaacgaacgtacttgcagatgtgacaagccgaggcggtga

SEQ ID NO: 198911 - DNA, 954 bp, Homo sapiens
  Payload ID: 19239
  Gene Name: vascular endothelial growth factor A
  Uniprot ID: P15692
  ENST ID: ENST00000523950
  CDS Start-End: 39-614
gcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacc

SEQ ID NO: 198912 - DNA, 606 bp, Homo sapiens
  Payload ID: 19239
  Gene Name: vascular endothelial growth factor A
  Uniprot ID: P15692
  ENST ID: ENST00000518824
  CDS Start-End: 1-576
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatctctcaccaggaaagactgatacagaacgatcgatacagaaaccacgctg

SEQ ID NO: 198913 - DNA, 784 bp, Homo sapiens
  Payload ID: 19239
  Gene Name: vascular endothelial growth factor A
  Uniprot ID: P15692
  ENST ID: ENST00000523873
  CDS Start-End: 39-737
gcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatc

SEQ ID NO: 198914 - DNA, 970 bp, Homo sapiens
  Payload ID: 19239
  Gene Name: vascular endothelial growth factor A
  ENST ID: ENST00000519767
  CDS Start-End: 1-970
ccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtatgtgacaagccgaggcggtga

SEQ ID NO: 198915 - DNA, 630 bp, Homo sapiens
  Payload ID: 19239
  Gene Name: vascular endothelial growth factor A
  Uniprot ID: P15692
  ENST ID: ENST00000518689
  CDS Start-End: 1-630
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtga

SEQ ID NO: 198916 - DNA, 3404 bp, Homo sapiens
  Payload ID: 19239
  Gene Name: vascular endothelial growth factor A
  ENST ID: ENST00000615393
  CDS Start-End: 499-1482
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctc

SEQ ID NO: 198917 - DNA, 3659 bp, Homo sapiens
  Payload ID: 19239
  Gene Name: vascular endothelial growth factor A
  ENST ID: ENST00000611736
  CDS Start-End: 499-1737
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctc

SEQ ID NO: 198918 - DNA, 3536 bp, Homo sapiens
  Payload ID: 19239
  Gene Name: vascular endothelial growth factor A
  ENST ID: ENST00000621747
  CDS Start-End: 499-1614
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctc

SEQ ID NO: 198919 - DNA, 3374 bp, Homo sapiens
  Payload ID: 19239
  Gene Name: vascular endothelial growth factor A
  ENST ID: ENST00000617771
  CDS Start-End: 499-1452
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctc

SEQ ID NO: 198920 - DNA, 1380 bp, Homo sapiens
  Payload ID: 19240
  Gene Name: vascular endothelial growth factor B
  Uniprot ID: P49765
  ENST ID: ENST00000309422
  CDS Start-End: 297-920
atgagccgcctgcccgccagcccgggcccagccccccgccgcccccgccgtccccgccgccgctgcccgccgccaccggccgcccgcccgcccggctcctccggccgcctccgctgcgctgcgctgcgctgcctgcacccagggctcgggagggggccgcggaggagtcgccccccgcgcccggcccccgcccgccgcgcccgggcccgcgccatggggctctggctgtcgccgccccccgcgccgccgggctagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtc

SEQ ID NO: 198921 - DNA, 979 bp, Homo sapiens
  Payload ID: 19240
  Gene Name: vascular endothelial growth factor B
  Uniprot ID: P49765
  ENST ID: ENST00000426086
  CDS Start-End: 15-581
ccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaa

SEQ ID NO: 198922 - DNA, 225 bp, Homo sapiens
  Payload ID: 19240
  Gene Name: vascular endothelial growth factor B
  ENST ID: ENST00000541681
  CDS Start-End: 1-98
cccacgctgcacccagcaccaccagcgccctgacccccggacctgccgctgccgctgccgacgccgcagcttcctccgttgccaagggcggggcttagagctcaacccagacacctgcagctgctggcacctggagctgtataagcaagtccaacattctaactcaggagtcagatacaggagggacaatgccagcagaggatgtcaagggctgtggtgaggggt

SEQ ID NO: 198923 - DNA, 2064 bp, Homo sapiens
  Payload ID: 19241
  Gene Name: vascular endothelial growth factor C
  Uniprot ID: P49767
  ENST ID: ENST00000618562
  CDS Start-End: 417-1676
gaggagggggacgagggctctggcgggtttggaggggctgaacatcgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggcttatgcaagcaaagatctggaggagcagttacggtctgtgtccagtgtagatgaactcatgactgtactctacccagaatattggaaaatgtacaagtgtcagctaaggaaaggaggctggcaacataacagagaacaggccaacctcaactcaaggacagaagagactataaaatttgctgcagcacattataatacagagatcttgaaaagtattgataatgagtggagaaagactcaatgcatgccacgggaggtgtgtatagatgtggggaaggagtttggagtcgcgacaaacaccttctttaaacctccatgtgtgtccgtctacagatgtgggggttgctgcaatagtgaggggctgcagtgcatgaacaccagcacgagctacctcagcaagacgttatttgaaattacagtgcctctctctcaaggccccaaaccagtaacaatcagttttgccaatcacacttcctgccgatgcatgtctaaactggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcctcttgtgatttctttaaaagaatgactatataatttatttccactaaaaatattgtttctgcattcatttttatagcaacaacaattggtaaaactcactgtgatcaatatttttatatcatgcaaaatatgtttaaaataaaatgaaaattgtattataa

SEQ ID NO: 198924 - DNA, 3948 bp, Homo sapiens
  Payload ID: 19242
  Gene Name: vascular endothelial zinc finger 1
  ENST ID: ENST00000258963
  CDS Start-End: 1-1022
atctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaattttcctccctcatgcagacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaatgtta

SEQ ID NO: 198925 - DNA, 2321 bp, Homo sapiens
  Payload ID: 19242
  Gene Name: vascular endothelial zinc finger 1
  Uniprot ID: Q14119
  ENST ID: ENST00000581208
  CDS Start-End: 42-1607
agcggggggagtggggaggaggggggtcggccgccgcagccatggaggccaactggaccgcgttcctgttccaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgacttttt

SEQ ID NO: 198926 - DNA, 825 bp, Homo sapiens
  Payload ID: 19242
  Gene Name: vascular endothelial zinc finger 1
  ENST ID: ENST00000583932
  CDS Start-End: 777-825
cggaagtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccagctattaaaatctttttttccacctgatggagaagtgtgaaaacaaatatttaatcctgggcttggcaatgtgtgcagtgaaatttgttggaaaacttaaaatttagagccgagagcagttgaatgggtaaagagaatatttcagtcttttctatggaaaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaaga

SEQ ID NO: 198927 - DNA, 2342 bp, Homo sapiens
  Payload ID: 19242
  Gene Name: vascular endothelial zinc finger 1
  ENST ID: ENST00000584396
  CDS Start-End: 90-1628
cagggacctggtgtgaccctcctgtgagagtgagcttcagcaatgctgtaaaaatactttatgttgccacagacatctgaattggtaaaatggcagcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgacttttt

SEQ ID NO: 198928 - DNA, 1581 bp, Homo sapiens
  Payload ID: 19243
  Gene Name: vasoactive intestinal peptide
  Uniprot ID: P01282
  ENST ID: ENST00000367243
  CDS Start-End: 173-682
gggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgagaggcacagaaatggacaccagaaataaggcccagctccttgtgctcctgactcttctcagtgtgctcttctcacagacttcggcatggcctctttacagggcaccttctgctctcaggttgggtgacagaataccctttgagggagcaaatgaacctgatcaagtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagtaacatctcagaagaccctgtaccagtcaaacgtcactcagatgcagtcttcactgacaactatacccgccttagaaaacaaatggctgtaaagaaatatttgaactcaattctgaatggaaagaggagcagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataa

SEQ ID NO: 198929 - DNA, 1584 bp, Homo sapiens
  Payload ID: 19243
  Gene Name: vasoactive intestinal peptide
  Uniprot ID: P01282
  ENST ID: ENST00000367244
  CDS Start-End: 173-685
gggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgagaggcacagaaatggacaccagaaataaggcccagctccttgtgctcctgactcttctcagtgtgctcttctcacagacttcggcatggcctctttacagggcaccttctgctctcaggttgggtgacagaataccctttgagggagcaaatgaacctgatcaagtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagcagtaacatctcagaagaccctgtaccagtcaaacgtcactcagatgcagtcttcactgacaactatacccgccttagaaaacaaatggctgtaaagaaatatttgaactcaattctgaatggaaagaggagcagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataa

SEQ ID NO: 198930 - DNA, 1257 bp, Homo sapiens
  Payload ID: 19243
  Gene Name: vasoactive intestinal peptide
  ENST ID: ENST00000431366
  CDS Start-End: 1-358
agtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagcagtaacatctcagaagaccctgtaccagtcaaacgtcactcagatgcagtcttcactgacaactatacccgccttagaaaacaaatggctgtaaagaaatatttgaactcaattctgaatggaaagaggagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataa

SEQ ID NO: 198931 - DNA, 2773 bp, Homo sapiens
  Payload ID: 19244
  Gene Name: vasoactive intestinal peptide receptor 1
  Uniprot ID: P32241
  ENST ID: ENST00000325123
  CDS Start-End: 114-1487
ggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgg

SEQ ID NO: 198932 - DNA, 1505 bp, Homo sapiens
  Payload ID: 19244
  Gene Name: vasoactive intestinal peptide receptor 1
  ENST ID: ENST00000443646
  CDS Start-End: 125-262
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcgg

SEQ ID NO: 198933 - DNA, 1002 bp, Homo sapiens
  Payload ID: 19244
  Gene Name: vasoactive intestinal peptide receptor 1
  ENST ID: ENST00000436487
  CDS Start-End: 125-262
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcagg

SEQ ID NO: 198934 - DNA, 3161 bp, Homo sapiens
  Payload ID: 19244
  Gene Name: vasoactive intestinal peptide receptor 1
  Uniprot ID: P32241
  ENST ID: ENST00000433647
  CDS Start-End: 625-1875
attttcccagcttactagtggaaaagcagcttctttcccacagttccagcaaaagccccagggctgatgctcattggcccaggttggggcatgtgaccattggcaagactcccattggccaggcctggggcaggtgctcactactggagccagagcggagtataagccctacccaatcactgaactacgtgggtcaagagtaaaggagctgtggcttccccccaatcagaagggcactggatgatggatgaactctgtgtggtgcgtcttcacactgacaccaggaggataaggaagtgactccctcagctgagtggctggcatgtgccaggctagagcagcttggctatggcagaacatccagccccaccgtgtggacggcagagatgaggaaactggtgtggggttgccggggccagcaaccacttttctaaagccaaagacgcagaaggtgctgccagtccaacgcttcctccatggaggccttcacccacccacacccatctaagagttcccaagacctgttttttctggctattcctagacagccatcacccccactcacatgtcttccacaagggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgg

SEQ ID NO: 198935 - DNA, 822 bp, Homo sapiens
  Payload ID: 19244
  Gene Name: vasoactive intestinal peptide receptor 1
  ENST ID: ENST00000446673
  CDS Start-End: 73-210
tcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactc

SEQ ID NO: 198936 - DNA, 770 bp, Homo sapiens
  Payload ID: 19244
  Gene Name: vasoactive intestinal peptide receptor 1
  ENST ID: ENST00000439731
  CDS Start-End: 114-770
ggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggg

SEQ ID NO: 198937 - DNA, 1393 bp, Homo sapiens
  Payload ID: 19244
  Gene Name: vasoactive intestinal peptide receptor 1
  ENST ID: ENST00000439910
  CDS Start-End: 120-257
agctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgaggtgggctgtaaggcagccatggtctttttccaatattgtgtcatggctaacttcttctggctgctggtggagggcctctacctgtacaccctgcttgccgtctccttcttctctgagcggaagtacttctgggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctcc

SEQ ID NO: 198938 - DNA, 743 bp, Homo sapiens
  Payload ID: 19244
  Gene Name: vasoactive intestinal peptide receptor 1
  ENST ID: ENST00000450274
  CDS Start-End: 364-743
acctcatcctccctggagcaggtctcccgaggcttgaagggccagggcacccaacaggtgctgagcgcgccccaccaggtcacccgggagcagggaacaccaaggaacccagagtcgggcctctttcgagccctcgcttcctctcgcctggcttcttcggcgcgaaggatgaattggggttgttgaaaattgatcaaacaacccgatctctgtcagcgcctggacacttgctgggccccagctcgcagcctgggaagataagtggcacttcctgtctcgtaatcggatttgcgcgcacgaaccctcggagacgcacagggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcag

SEQ ID NO: 198939 - DNA, 2427 bp, Homo sapiens
  Payload ID: 19244
  Gene Name: vasoactive intestinal peptide receptor 1
  Uniprot ID: P32241
  ENST ID: ENST00000438259
  CDS Start-End: 392-1135
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgaggtgggctgtaaggcagccatggtctttttccaatattgtgtcatggctaacttcttctggctgctggtggagggcctctacctgtacaccctgcttgccgtctccttcttctctgagcggaagtacttctgggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttggattggc

SEQ ID NO: 198940 - DNA, 2681 bp, Homo sapiens
  Payload ID: 19244
  Gene Name: vasoactive intestinal peptide receptor 1
  Uniprot ID: P32241
  ENST ID: ENST00000543411
  CDS Start-End: 160-1389
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttggattggc

SEQ ID NO: 198941 - DNA, 3944 bp, Homo sapiens
  Payload ID: 19245
  Gene Name: vasoactive intestinal peptide receptor 2
  Uniprot ID: P41587
  ENST ID: ENST00000262178
  CDS Start-End: 187-1503
gtgcattgagcgcgctccagctgccgggacggagggggcggcccccgcgctcgggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttatacactgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttttgagacggagtctcgctctgtcgcccaggctggactgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagccagctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggtcggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacgtgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcagcaggtgtctttaactgtcattgtgtgtggaatgtcgcagactcctccacgtggcgggaatgagctgtgtaaatacttcaataaagcctgacttcacatctgca

SEQ ID NO: 198942 - DNA, 1491 bp, Homo sapiens
  Payload ID: 19245
  Gene Name: vasoactive intestinal peptide receptor 2
  Uniprot ID: P41587
  ENST ID: ENST00000377633
  CDS Start-End: 62-1330
aaacttcactccccagggctcccatccctggtgacaaagatcacagcagctggcactgcagatgcctttgtgggaggcaccatctgatcatcccgccaaccctcctgcaaccctgcaaggacacaccagcctcccagggtgccaggaggagcctgccagagacccccagagcggcctgccccaaatcacctctgagagcagcagcttttctgaaggaagcctcccctcatggtcctcaggcccagcaggtgccaagctcaatgccagccacgagggcattggctcatcgagtgatgggaacggggacagcaaggcggccacagagagggtggtctcagccatggacacagtacggcggaagcatcccgagatcacgttttatattctggtgaaggccatttatacactgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctgg

SEQ ID NO: 198943 - DNA, 1926 bp, Homo sapiens
  Payload ID: 19245
  Gene Name: vasoactive intestinal peptide receptor 2
  ENST ID: ENST00000402066
  CDS Start-End: 89-1828
tcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgagtgcgcccgcgacccccgccccacggcgcctcggacccggttctccccttccgagaagagcgctcctcccgccggtcttcgccttcctcccgggtgctggagcgcgggcggggtccgggagagggagcggggtcgcccggggtccggagcttcctcccggagagcgtgaagcgctgagctccggtcccgccgggttgcgggactcgggttgggaggctgcctgcgcccttccccgcgccccaccgtccggggtttgctggaaacgggatcgtttcttcctggacgcgtcaacgatgagctcgttcggggccgtcccgggagctgggagctgcgggcgcctgcgcgggctgcgcgtttcacggggagatcggggttggcgttggccgcagatgcctctcggtccctccctgtacttactggtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttatacactgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgt

SEQ ID NO: 198944 - DNA, 717 bp, Homo sapiens
  Payload ID: 19245
  Gene Name: vasoactive intestinal peptide receptor 2
  ENST ID: ENST00000421760
  CDS Start-End: 82-315
ccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaaggccatacaaagggattcatcctcattcacgccggaggtttaaagaggatcctggacccacatacctacccattggctccatgaccagtgcttttataattacaaaatcattgagaaattaagtcacaggaagcctcgtgtgtggtatacactggtgataaagcaagtcccatgcagtctgagatggcaagggaccttctagggaaagggcagtgacccagaagcccgactgctcggctggctcccgcactccgtcctgtggtcagagtgtgtttcctcccctctgtgaacctggtctcctccccagtgtgaggacaggggctctcgccttcttcagggagttgctgggaggacaaaatggagtatatgtaaaagtcatttcctagataagggggagcatgtcgtaagagtctcttgaaatttaattgatgtttatgtcattgacattgaaataatgagaaaataaatccaaatccagagctcaaa

SEQ ID NO: 198945 - DNA, 2305 bp, Homo sapiens
  Payload ID: 19246
  Gene Name: vasodilator-stimulated phosphoprotein
  Uniprot ID: P50552
  ENST ID: ENST00000245932
  CDS Start-End: 357-1499
aaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagatatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggagaaggggaggaaacttctcccctcccaccttcacctttagcttcttgaaaatgggcccctgcagaataaatctgccagtttttataaa

SEQ ID NO: 198946 - DNA, 424 bp, Homo sapiens
  Payload ID: 19246
  Gene Name: vasodilator-stimulated phosphoprotein
  ENST ID: ENST00000592139
  CDS Start-End: 285-424
agagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggcctggccgcagctattgctggagccaaactcaggaaagtcagcaag

SEQ ID NO: 198947 - DNA, 804 bp, Homo sapiens
  Payload ID: 19246
  Gene Name: vasodilator-stimulated phosphoprotein
  ENST ID: ENST00000588482
  CDS Start-End: 1-551
gagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacagatgagtgccttgaattctttccgcacattgacccagctgtccatcaccaattggagttggcaggaggctggaatgcgcttgccaaccttggtactggatgttctccagtacttttccggctccaaggatccagaattctcccctagaatcctccagtcactctgcgaccttgacagcgatgtcatggtgtcgatgtaggggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtgg

SEQ ID NO: 198948 - DNA, 1725 bp, Homo sapiens
  Payload ID: 19246
  Gene Name: vasodilator-stimulated phosphoprotein
  ENST ID: ENST00000586014
  CDS Start-End: 267-578
ccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaactggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagatatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggagaaggggaggaaacttctcccctcccaccttcacctttagcttcttg

SEQ ID NO: 198949 - DNA, 696 bp, Homo sapiens
  Payload ID: 19246
  Gene Name: vasodilator-stimulated phosphoprotein
  ENST ID: ENST00000589627
  CDS Start-End: 520-696
actcggggcggggccggcaagacacgctgcggaagcctcagagggtgtctgggctcagcccggagccggcgtgtgggggcgggggctcccgggagggtctcctcacctccgggccctcctgagggctgggatgatcctgctgtcctccgcaggcgaaactgagtcagagcggggcgtgcgtgggccggaggctttacacaccaaagaagccggcgcctcctgcccaccccgggcgaatgccgggccccccactcccgcactcctcgccagtccccacctccaccccaccccacccccgaccctgcggctgaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcag

SEQ ID NO: 198950 - DNA, 388 bp, Homo sapiens
  Payload ID: 19246
  Gene Name: vasodilator-stimulated phosphoprotein
  ENST ID: ENST00000590603
  CDS Start-End: 282-388
gtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgaggcagcagcccggcccgtcggagcacatagagcgccgggtctccaatgcaggaggcccacctgctccccccgctgggggtccacccccaccaccaggacctcc

SEQ ID NO: 198951 - DNA, 5728 bp, Homo sapiens
  Payload ID: 19247
  Gene Name: vasohibin 1
  Uniprot ID: Q7L8A9
  ENST ID: ENST00000167106
  CDS Start-End: 634-1731
gctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctacatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatttacctcaccaacagcatgcccaccctggagcgcttccccatcagcttcaagacctacttctcagggaactacttccgccacatcgtgctgggggtgaacttcgcgggccgctacggtgcgctgggcatgagtcggcgcgaggacctgatgtacaagccgcccgccttccgcacgctcagcgagctcgtgctggacttcgaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaagattggcaaagggacgggccctccctctcccaccaaggaccggaagaaggatgtttcttccccgcagcgggcccagtccagcccccaccgcaggaacagccgcagtgaaagacggccctcgggtgacaagaagacttccgagcccaaagccatgccagaccttaacgggtaccagatccgggtctgaggcggatgccagcaccccaggccccacccactcttgggggccaggatccacctgctggaaccagccttatgcatggggaaggcggggctggtgacaaggcagggcaagaggctgcaggaagagtgtgttccagctcagccccccaagctgctctcgctcccactgagccaagccccctaactttgggcctagaggccgttagtattttatttggagtttttaactctacaactgaagtttaaggtatttggggaaaacttagtccaaatggatctgctgatggtgggaaggccagtgcttaacaaatccatgtgtcatggggccaggtgagggaaactgctggttctgctggtgcctctgcccctggcttctctctgggagttgggtgcatcttatcagtgggaaatctcccagccttaccaggcctgtgatggggggtgggggtggggtggagatgtttctccagttctgcctgccctggcagaatcttgacccagggaaagggaagcagggtaggagtccttctgagaaaggtctgtgtagcccattaaccaggagcttggcacaggccacatctgccccaagagcatgagctcgtggctcaggagagccttcaggcccttgaggcccccatgggcagtgctgtgtgggcagaggaggggtgatatgagagcgagcccagggaaggacctctgggcaaaaagttcccaggccctaactgcgtctacttgctcagtcccagctctgcctgttgctctagcccacaggctccctgcggagggtctgggcttggcggaggacccagaatggcactgaggccagcatggctgtgggagttgagcaaaccctgggtgccagtccaggagctgtggctggacatggggtgatggggcgggatgcttgggcctgggtctctccgccagcagtgccaggagcccttgctggggaaatcaagaccagactaggatgcttctgccccaggcctgccttccattctttaacagcccatcttggcttggggttgcaatgatggctgggccagtcacttgtggcagggcatcagggccctggcagggaagaacctaggcacctggggttgtccccagcctgcccgtcagcatgagatacccagtgggaaagtgagaggatgcggagaggttggcagagccaggggtaggttctggaggctcaagcaacaaggaggtgcaggtaaagggtgcagtgcagccactgagggacagctgggaactgggggatgcaagtgagaaagggatgtgggggagagttcaggatcaggctgcttgaggagtaatgggttacctacagcagagacgagatggctgtttgtcaggaggcggtagaaaggtagaaaggattcagattgtggaagggtaaacggatgagatgaccattaaggttttgttttactgagaggctgtaagtctgccagggacagctgtcagtaaggctgcagaagggctggggggctacacaaggaagagcagaactagggttgtaagctcaaatgacgagcaaacggtgagaaggaggcctgaagggctgtgtggggactatggctacctgaagagggcacaccctgttaaaggggccacagctgctcagctgttcttacagtgccggccctgtgttgccagattgtctgctttgtcagaggccagaattctgactttttatgtgaaataggatttttaaatgctggtgatcacttaaaaaaaacttaaaaacccaatactggcaaaagaggatgccagtttgcaatccctgaagtagagagagctcgtgctggggagaagtccaccaagatgctttgaggcgggctgtagcaaagtcctgtttctcagagctgggctgggctggggtaggatccttgcagctgaggaggaggaaaagccactgagtctcctcccagagcgggacaaaccagaggccctttgcagttgctgggtcaccagcgggggtggcgcatggagtacagacagtgtagctcttggcctgccagggagacggatggtgcctttgaagcaaagaggaagggaaggcagaaccagggatgcctttgctgatgagagtgcctgtcagggaaggcgccacaggctggcagctcttcaaaccagcagcgcttgacccagagccagatccagcatggcctggccagaggcaccctgggaggccagctggtcagtcccttgcctccccaagttccccctggggtcaatgagccctgggaggatgcctaacctaactccagccagactaataggggcatggtgacccttgactcaccatcccatcccagctttcagggagtgggggtagtgtggtctccatgttcctactatgcctaagaagagatggctcaccttgggaggtgccaggctgaaactaggtcctttccgggtctggatgctgccgctcaggagcaggggcgtggcctcagctgcctctgggagcttcccgggaatgacagggtttgaggggagtagatatgagagggagccgctcctggttctggagtcttaggaggttccaacttgcaggatcctttcccagagccctccatggagaaaacagcaaaatgaagcccttacctgcttgctgtctgcaagggagggagccgagccccagctgataatcccccagcactcacccttcctgagctgagacttcggggctgtggagaccagcacaggacatagtggtgctttttaaatttatttttaactgtttctcatatgtagcaacccctcctcccctcctgggcatgtttacacaggctctgctctgggggctggcctggctgtgaggtttctggggaggcagagaggcagggactttggggccttagtcaccatccatggtatcacctcatctcacttcctgtgagggacagggcctggctgatgtgatcccagctccccccagttcaggactgtctttcagctcctttgcccctggaggtgggggctgctggctgaggaggggtcaaggtgagttcaagaaagctacctgtggaaaatggaccaggttgggggggtgattgcaaagtctccccaaagcctggctcctcatgctcagtgccaggggcagaacactggggagccaggtatagagagccttcctgtcataactgccagtcctcttcctccaaggcctctgcatattctcatgttcccctcacccatcatgccagccacccctatccctcttctagcagggccaagatggggacagcagcagccctctggccttgggatgtgatgataaagcaagcctagggccagggtttggggagcagagagagccaagaagttgaccacgtgtgatttccagcccttcccactgggacttgacttcccaggtcaaggagtccgtctcattctggctggtcgagtgaccagaggcctgtgtgaatgtgtgcacctgcttttcctgcctggaatgttttctggctcagctgcagcaacatctgtgagcccagtgtctgccctgtgtccctgggctcgctccaagtgcaggaacatacatgcagggcccaacatgatgatggtgtgaagggcaggaaacagtcctctgaaggagtggggaggtgggcagtctgcccccgccaggtaccatcgcctcctgccagcttccttagaccaggcagggctgccatggtgctagctgcaagtccatcagtattgaccgtctcgctccatcttggtcctccggagtcccaagtttccttttcatcaaatctgacaagagagaagaaacatgggtgtgcttggcccacagggcctggtggtgatggacctccccgctccctcaagctctggatggctgcagtgttgtactagactttgttcaggctgttctcatctcagtattgccccttcctttcactttcacacttcatctcattcctgttgtcactttccccgaaacgaataaagtctccccagctcctgctgtgtaggctgggcagaaaccacaa

SEQ ID NO: 198952 - DNA, 1462 bp, Homo sapiens
  Payload ID: 19247
  Gene Name: vasohibin 1
  Uniprot ID: Q7L8A9
  ENST ID: ENST00000554237
  CDS Start-End: 494-1108
cgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctacatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatgtatccttcctcacctgaaggggaggggtccgggcttctctgggcctcagcttcctgctctgaaagtgagggtggggtaggttgaatgggctccagggctctcccatatgcagtcatctgcttggccccaagatggagaagcaccccactaaagtggaagaaccccccaaaatggaggagccccgaggtcccagtaccccacatctcagttgctaccttcccaggcttactgggcagctcttttttgagtcacgtggatacagggaccgttttctgaaccccaaatcagggcacagtgtctcacaaagacagttgtaccatttccaagaactagacagtctgggaggcacagttggaatgcccagatgttggcatttccagaacatgttgatttctggacgagatattaaagcaaaactgccttaaaaaaaaaaaaaac

SEQ ID NO: 198953 - DNA, 1096 bp, Homo sapiens
  Payload ID: 19247
  Gene Name: vasohibin 1
  ENST ID: ENST00000554743
  CDS Start-End: 456-731
ggatgtttcttccccgcagcgggcccagtccagcccccaccgcaggaacagccgcagtgaaagacggccctcgggtgacaagaagacttccgagcccaaagccatgccagaccttaacgggtaccagatccgggtctgaggcggatgccagcaccccaggccccacccactcttgggggccaggatccacctgctggaaccagccttatgcatggggaaggcggggctggtgacaaggcagggcaagaggctgcaggaagagtgtgttccagctcagccccccaagctgctctcgctcccactgagccaagccccctaactttgggcctagaggccgttagtattttatttggagtttttaactctacaactgaagtttaaggtatttggggaaaacttagtccaaatggatctgctgatggtgggaaggccagtgcttaacaaatccatgtgtcatggggccaggtgagggaaactgctggttctgctggtgcctctgcccctggcttctctctgggagttgggtgcatcttatcagtgggaaatctcccagccttaccaggcctgtgatggggggtgggggtggggtggagatgtttctccagttctgcctgccctggcagaatcttgacccagggaaagggaagcagggtaggagtccttctgagaaaggtctgtgtagcccattaaccaggagcttggcacaggccacatctgccccaagagcatgagctcgtggctcaggagagccttcaggcccttgaggcccccatgggcagtgctgtgtgggcagaggaggggtgatatgagagcgagcccagggaaggacctctgggcaaaaagttcccaggccctaactgcgtctacttgctcagtcccagctctgcctgttgctctagcccacaggctccctgcggagggtctgggcttggcggaggacccagaatggcactgaggccagcatggctgtgggagttgagcaaaccctgggtgccagtccaggagctgtggctggacatggggtgatggggcgggatgcttgggcctgggtctctccgccagcagtgccaggagcccttgctggggaaatcaagac

SEQ ID NO: 198954 - DNA, 2960 bp, Homo sapiens
  Payload ID: 19248
  Gene Name: vasohibin 2
  Uniprot ID: Q86V25
  ENST ID: ENST00000366964
  CDS Start-End: 328-837
ggcgacggccccagcaagccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcataacccacagctaaaacaagggtctagcttctcccacactttctgttccatttttcaccagactcccggctcttcagcctgagaggaatatggtgcagagaaactgtgatggcatcgacatattggtggtgatgaccacctcccttacacaatagtctcatccctgcacaattttatacattcgagcatcatgccattggaatcacccacaaccctttgaaattgtggggatagacccaggaacagcctttgagcctgatctgccacaatcagatagaagagcaaagatgctccgaagtcctatgggatggatggctgtaagggacagtggaaaaggaaacactgcaagacaggagcttgagagatggtcccaggcaagatcagttaggtccttgagcgctgtgctgagaaatgacttttttccaaaaggcaatgggcaacccagatgaaagctctgaagcagaggtgtggcatgcttaggtatatgctctagagaggtagttctccaaagcacaggctgaaggacagattgggaaaggctgggctggatcagcaaagcccgttgggagctgttacatgagggaatggtgaggctagactcatggccctggggatgggaatggatttcagggaatggttttaagagctatcaaggagatagaatgtataggacttgcaggccaaccagacgcaggagttaatgaggaaggagtcaacgtctccaggtttctgaattgggcaatcgactgcgggattagctggaggaatgagagtggcagagaaaggatatgcgtcaatgcagacctgaactaagacagtgccagtgaaggtggagggaagggatggaggcatacatcatcaccaccactaggggactgcttagatgggaggagttattggagaaaggcagtgactccacatttctggcttgcatgataatgccacaagggaagaacttcaaggagaggatcggatttagggaaagatgagctcagatttggacatgtgaaatttgaggtgccttgtgggatgtcggaatgaggtatttgcaatgtggagctcacaggggaatctgcactggaaatgcgaatttaggagctgtgattaggaggttgtgcttactgttcaataagtgaaaggagaaaaagatcaaagatgaaatcagtattttttggtctagtttggcacaaagagcccatgaaagagacttaagaaggaaagagaggtagaaagaaaaccaggagagaaaggggatggagaggtcagtggaaggacatgtggctcagaattagactggggacaggaggattggtctagtctgttttctgggtctcctggacatctttgtgggaaggagaatctctgtgcctctctgcagtctgtggaacacttgcagccctgatctgaaaccagattgaccacaggtgccttggctgacatttgaaaaatggaaacttgaaccttactgaggcccctccccaaccctcttgtcatcctcctccctgtttcccacaaaggagatgaaacatgtgcctggggaacccagcaggaagctgggaatgggggtcggggcagcagatggctcagggccccaactctttagtggcaggagtcagccacagctgttcagcgaagcctcctgcaagtttaatgggggcagatgattggctggggatttgctggtggaagagatcaacgaaggggaacacaagcccaggcccttcatggggtagacaagctaacttcagactctttgttgaggggtgtctgagtgcctctggatttaggtcattgaaatgaccacctcccttacacaatagtctcatccctgcacaattttatacatttgcgcatcatgccactggaatcacccacgaccttttggaattgtggggatagacccaggaacagcctttgagcctgtccaaatcagagacagtgtgctcgtggttttcctttgttcttatccttctgacatttcagaaaagtgcaggaaggtggagagcttcagttcacgctgctgaactcagggaaatttgactcttgcacacagacaggaaacacagatccgaattcttcttcttttttttttttttttgagacggagtcttggtctgtcgcccaagctggagtgcag

SEQ ID NO: 198955 - DNA, 3572 bp, Homo sapiens
  Payload ID: 19248
  Gene Name: vasohibin 2
  Uniprot ID: Q86V25
  ENST ID: ENST00000366965
  CDS Start-End: 311-1246
gccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacactacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttggactatgtccctcactcaagatcttaaggataaccgtaactgaagttttatatttttccatttacctactttcttttacttgctttgaacattatgcctcaccaatagtaaatgttcatgaaataatctcttgaacttttggtatagtaaggtaactctaacagtattactgtctttttcagcaataacagaaagcaaaaatgggtgggttttttttaagcagttattacctcagcattttgacatcagatatgcaaacttaatggcgttttgtttttttatattctatttgtattctttccccagtatttcccatggggatctccacaagtttggagttttttcctggtgcacacacgtgaggagatttaaggtactatatgcaagtgttttactaaaaagcactgaaattcttctggcaatacaagaaccattttcaggatcttggagttacttccttcttaatctttcttaaagcattcactgatgtttttgttttttcaaaatgaaacaaaaatatcacattgagaagctagtctatgttctgtcactaacatttaaactttgcagactctaacaaaaagcacaagaggtcacgtactattatacaaatttagcggtactggatttacctctgacattaacacactcaggcagagaccaggagtgatcagcaggtcttcagaaccaaaaaacctttctgttcacatttcatctgatttttaaactgaggcaggctttgattcttctgaaggatgccaagaatcaaactaagggaggactcactgttaaagatgtgttctgatgtcttatattaagaccaaatgtgacatgatgtgattatcttccagtactttgcttttaggtaccatttcatgacattttaggaatgagtattggaaaatataaagaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaaagctcattgagattctttaccaattctttacaagatttctgggggtgacagggaaagcaaaaggacttcaaagcaaaagggtgcacaagagcttacttcaccctgaaaatcagtattattaatgaaaagtactgttttcttaaagaagtcgaatgtcctttagatgaacaagaccaagtatacatctccattagattaaaatgtagcacagggttaaaaattatcagtttaatctctttaagaacagtattatcagagtttaaaatgagttagctctgtttatctacacacagcaaacccattcgcagcctcttggccacatgtattcagatgtttgaaatagtgaatcatttcattttcattctaaaacaatactgacttagccatataccttctgtttgtcaatctgaaacttgcttacatctaataagtagacctcttataacactgcaaccattctaagagttggaatttatttttgccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttgatttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaa

SEQ ID NO: 198956 - DNA, 4224 bp, Homo sapiens
  Payload ID: 19248
  Gene Name: vasohibin 2
  Uniprot ID: Q86V25
  ENST ID: ENST00000366968
  CDS Start-End: 351-1223
attcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttggactatgtccctcactcaagatcttaaggataaccgtaactgaagttttatatttttccatttacctactttcttttacttgctttgaacattatgcctcaccaatagtaaatgttcatgaaataatctcttgaacttttggtatagtaaggtaactctaacagtattactgtctttttcagcaataacagaaagcaaaaatgggtgggttttttttaagcagttattacctcagcattttgacatcagatatgcaaacttaatggcgttttgtttttttatattctatttgtattctttccccagtatttcccatggggatctccacaagtttggagttttttcctggtgcacacacgtgaggagatttaaggtactatatgcaagtgttttactaaaaagcactgaaattcttctggcaatacaagaaccattttcaggatcttggagttacttccttcttaatctttcttaaagcattcactgatgtttttgttttttcaaaatgaaacaaaaatatcacattgagaagctagtctatgttctgtcactaacatttaaactttgcagactctaacaaaaagcacaagaggtcacgtactattatacaaatttagcggtactggatttacctctgacattaacacactcaggcagagaccaggagtgatcagcaggtcttcagaaccaaaaaacctttctgttcacatttcatctgatttttaaactgaggcaggctttgattcttctgaaggatgccaagaatcaaactaagggaggactcactgttaaagatgtgttctgatgtcttatattaagaccaaatgtgacatgatgtgattatcttccagtactttgcttttaggtaccatttcatgacattttaggaatgagtattggaaaatataaagaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaaagctcattgagattctttaccaattctttacaagatttctgggggtgacagggaaagcaaaaggacttcaaagcaaaagggtgcacaagagcttacttcaccctgaaaatcagtattattaatgaaaagtactgttttcttaaagaagtcgaatgtcctttagatgaacaagaccaagtatacatctccattagattaaaatgtagcacagggttaaaaattatcagtttaatctctttaagaacagtattatcagagtttaaaatgagttagctctgtttatctacacacagcaaacccattcgcagcctcttggccacatgtattcagatgtttgaaatagtgaatcatttcattttcattctaaaacaatactgacttagccatataccttctgtttgtcaatctgaaacttgcttacatctaataagtagacctcttataacactgcaaccattctaagagttggaatttatttttgccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttgatttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaacaaaaaacaaaacaaaacaaaaaacatgttatatgcacccccctcccaaagctgattttaagactggctagaattcaaaatataaaaaataaaactatgaagtgatttgaaatcggttttaaaaagttgttagtgcaagagaaattttatgtttaagccatcatggcaatatatgcaaagtttaaatgaatgacagaaatcttgattttagactgtatgttgtgctgttttgagtacactttatttcggagatatttagtattttctatacactctgaaatcatgagcatttcactttttctaagtcaattatttcataaggattttattaatagatattggtaaatagaactttggaaatcttaattcagaattcttactatacctgagtcttttgtaagctatagttttatgtacaaccttgtacagtttttttgacatacaattcagaactttgtttattctcttggactttgttctggccaatacattttttttaaatctttaagaagaactgtgattgttttagtgggtatttttctaattaaatgaaaacttgtataatggtattttagagaatgccagtaagtgcatgtttcaagttaatgtttttctcatcacttgtatgtttctaacacagcatgggactttaataaaaccatcctggaaacttaa

SEQ ID NO: 198957 - DNA, 581 bp, Homo sapiens
  Payload ID: 19248
  Gene Name: vasohibin 2
  ENST ID: ENST00000490792
  CDS Start-End: 507-581
ttcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggtaatcgcagggctggaagcccgtcatcgattctcagggaggctgtcagcgtgcaggggggagcggggagtgtcgtggagacactccgggacccctcactcggttccgctgtgcgtccacttagctgtggtgtcagctgtgtctccgctgatttcaggcaccgccggtaagcagggagcctccgcggagctcccgccgccgctcccccttggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttg

SEQ ID NO: 198958 - DNA, 1068 bp, Homo sapiens
  Payload ID: 19248
  Gene Name: vasohibin 2
  Uniprot ID: Q86V25
  ENST ID: ENST00000517399
  CDS Start-End: 1-1068
atgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttag

SEQ ID NO: 198959 - DNA, 1206 bp, Homo sapiens
  Payload ID: 19248
  Gene Name: vasohibin 2
  Uniprot ID: Q86V25
  ENST ID: ENST00000366967
  CDS Start-End: 111-866
agcagcagcagcagcagcccctgctctcccgccgcccggagaggctctgcagccatgaagccaaccgtcccgagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttggactatgtccctcactcaagatcttaaggataaccgtaactgaagttttatatttttccatttacctactttcttttacttgctttgaacattatgcctcaccaatagtaaatgttcatga

SEQ ID NO: 198960 - DNA, 1369 bp, Homo sapiens
  Payload ID: 19248
  Gene Name: vasohibin 2
  Uniprot ID: Q86V25
  ENST ID: ENST00000366966
  CDS Start-End: 383-1255
gttgcggtggccaatagacgcattcggaacatcggcggctgcccgggtgacttggttatatgtcacagaataacattcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggtgacctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaa

SEQ ID NO: 198961 - DNA, 2806 bp, Homo sapiens
  Payload ID: 19249
  Gene Name: vasorin
  Uniprot ID: Q6EMK4
  ENST ID: ENST00000304735
  CDS Start-End: 156-2177
gactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccgggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacagccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagagccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgttt

SEQ ID NO: 198962 - DNA, 2806 bp, Homo sapiens; identical to SEQ ID NO: 198961
  Payload ID: 19249
  Gene Name: vasorin
  Uniprot ID: Q6EMK4
  ENST ID: ENST00000622615
  CDS Start-End: 156-2177

SEQ ID NO: 198963 - DNA, 2825 bp, Homo sapiens
  Payload ID: 19250
  Gene Name: vav 1 guanine nucleotide exchange factor
  ENST ID: ENST00000304076
  CDS Start-End: 95-2566
agctgtcgctccacaggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccagttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatagaa

SEQ ID NO: 198964 - DNA, 2627 bp, Homo sapiens
  Payload ID: 19250
  Gene Name: vav 1 guanine nucleotide exchange factor
  ENST ID: ENST00000539284
  CDS Start-End: 1-2370
atgattgcatcgctgcactccagcctggacaacagattcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatag

SEQ ID NO: 198965 - DNA, 2775 bp, Homo sapiens
  Payload ID: 19250
  Gene Name: vav 1 guanine nucleotide exchange factor
  Uniprot ID: P15498
  ENST ID: ENST00000596764
  CDS Start-End: 81-2522
aggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccagttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatgg

SEQ ID NO: 198966 - DNA, 2717 bp, Homo sapiens
  Payload ID: 19250
  Gene Name: vav 1 guanine nucleotide exchange factor
  ENST ID: ENST00000599806
  CDS Start-End: 86-2458
gtggtgcacgcctatagtctcagctactcaggaagttgaggcaggaggatcgcttgagcccaggagtttgatgctgcagtgagctatgattgtgctaccactgtactccagactggacaaaagattcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatagaa

SEQ ID NO: 198967 - DNA, 2620 bp, Homo sapiens
  Payload ID: 19250
  Gene Name: vav 1 guanine nucleotide exchange factor
  Uniprot ID: P15498
  ENST ID: ENST00000602142
  CDS Start-End: 83-2620
acaggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccagttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctga

SEQ ID NO: 198968 - DNA, 4837 bp, Homo sapiens
  Payload ID: 19251
  Gene Name: vav 2 guanine nucleotide exchange factor
  Uniprot ID: P52735
  ENST ID: ENST00000371850
  CDS Start-End: 33-2669
actgccctgagccggtcgggcccgcgggcgccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgattagatacatgcagaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtctcacgggaaaatgtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagcttcctgtgcttcctacaacttttcttttctcagtcctcagggcctcagctttgcttctcagggcccctccgctcccttctggtcagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgca

SEQ ID NO: 198969 - DNA, 5101 bp, Homo sapiens
  Payload ID: 19251
  Gene Name: vav 2 guanine nucleotide exchange factor
  Uniprot ID: P52735
  ENST ID: ENST00000371851
  CDS Start-End: 327-2933
cgcggattggggagcgctgcggcgactggctgcgtggagcccggcccggggcccgcaggcacttgcgtgtgtgaagcggggagatccggcgcgctgcccgttgcccgccccgcggccgcacgtgggcgggagcggcggcccgagaggagcccgaggagtaggaggaggaagaggaggggacgcacggcggcgcagcgggggacctggggcagcccgcgcgaagccccgccccggccctgagccccgcgcgcgcgcgggcgggatgccccgcggccgctgcactttggctcgagcactgccctgagccggtcgggcccgcgggcgccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagcttcctgtgcttcctacaacttttcttttctcagtcctcagggcctcagctttgcttctcagggcccctccgctcccttctggtcagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgca

SEQ ID NO: 198970 - DNA, 4691 bp, Homo sapiens
  Payload ID: 19251
  Gene Name: vav 2 guanine nucleotide exchange factor
  Uniprot ID: P52735
  ENST ID: ENST00000406606
  CDS Start-End: 4-2523
gccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgca

SEQ ID NO: 198971 - DNA, 4990 bp, Homo sapiens
  Payload ID: 19252
  Gene Name: vav 3 guanine nucleotide exchange factor
  Uniprot ID: Q9UKW4
  ENST ID: ENST00000370056
  CDS Start-End: 276-2819
gcggcagccgccgccgagccggccggggcgcacggagagcgcgcgggactcgctgcagcggcggccgggtcgcggcgcacccgggccgggaccggagccgagcctagcgcggcgcccgcgacccgtcagccgcggctcctgctccctcgatcccgcgcggggaaagggccggcggctgttggcgtcggcggggcgcggaggaaccgcggcggcggcggcggcggccgcatccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaagggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctagcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagccctcgtgtaatacggtgaattagagtggtatttcactttgtattattttgtaaatatgtcaatataataaatagtgactaaattgat

SEQ ID NO: 198972 - DNA, 1293 bp, Homo sapiens
  Payload ID: 19252
  Gene Name: vav 3 guanine nucleotide exchange factor
  Uniprot ID: Q9UKW4
  ENST ID: ENST00000415432
  CDS Start-End: 74-937
aaagcagtggtgttttaccactctgcagagaaagctaaggttgctaaccaaacaaaataactttacactgacaatgccaatttttacatttctttcagaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatctta

SEQ ID NO: 198973 - DNA, 546 bp, Homo sapiens
  Payload ID: 19252
  Gene Name: vav 3 guanine nucleotide exchange factor
  ENST ID: ENST00000529809
  CDS Start-End: 1-546
agtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcag

SEQ ID NO: 198974 - DNA, 4510 bp, Homo sapiens
  Payload ID: 19252
  Gene Name: vav 3 guanine nucleotide exchange factor
  Uniprot ID: Q9UKW4
  ENST ID: ENST00000527011
  CDS Start-End: 141-2768
ctcctgctccctcgatcccgcgcggggaaagggccggcggctgttggcgtcggcggggcgcggaggaaccgcggcggcggcggcggcggccgcatccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagctccccctctttgttctgtggcttttcttttgtaactcctccagactacagctttgttcccccttcttccactcctttctggtcagtgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaagggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcg

SEQ ID NO: 198975 - DNA, 1374 bp, Homo sapiens
  Payload ID: 19252
  Gene Name: vav 3 guanine nucleotide exchange factor
  ENST ID: ENST00000529413
  CDS Start-End: 74-232
aaagcagtggtgttttaccactctgcagagaaagctaaggttgctaaccaaacaaaataactttacactgacaatgccaatttttacatttctttcagaacaagggacactcaaactaccagaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactg

SEQ ID NO: 198976 - DNA, 2271 bp, Homo sapiens
  Payload ID: 19252
  Gene Name: vav 3 guanine nucleotide exchange factor
  ENST ID: ENST00000490388
  CDS Start-End: 1-1850
agtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccagatgtgccctgtctccttcatttctttatttccatggcccctgctactagaagcattgtaaaaagccaaaagaagaacaagaaattctgaggacatgggtgaaaatgcagccttgaggtttctgaaaataacaggagacagacaaggctggtgtccagcaacaatactgggtagctctttttgtccccacttacacagcgaaggataaagaagagatcctatggacacttagtaaggattacttcatgttttaattcaaagtactttggaaagaagactttgagcagagtggaatagcaggaggtttttgtaaggtgaaatagaatgaaagtgcagccaagaatttttctgtcttcaattttaaagaacaccggcataactcatttttctttttttcccctgtgttctttttgaccttcttagcagctcctgactttctcccttggggatttttctctgtatagtcagcgctgactcccttagaaatcctgaaccccacacccgtatcgcg

SEQ ID NO: 198977 - DNA, 545 bp, Homo sapiens
  Payload ID: 19252
  Gene Name: vav 3 guanine nucleotide exchange factor
  ENST ID: ENST00000525231
  CDS Start-End: 74-232
aaagcagtggtgttttaccactctgcagagaaagctaaggttgctaaccaaacaaaataactttacactgacaatgccaatttttacatttctttcagaacaagggacactcaaactaccagaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctgttttagagatggggtcttgctctgtcacccaggatggagtgcagcgatgccatcataacccattgcagccttgaactcctgggctgaagtgatcctccaaagtgctgggattacaggtatgctggagcaatggaaagattgcaagcagagaccgaacttattaatagggtaaatagtacttac

SEQ ID NO: 198978 - DNA, 1439 bp, Homo sapiens
  Payload ID: 19253
  Gene Name: VCP-interacting membrane selenoprotein
  Uniprot ID: Q9BQE4
  ENST ID: ENST00000398226
  CDS Start-End: 34-603
cggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcagtggaaacaagggtgggccttgtgaggtgtggggaagccctgggaccctcactccccttccagtgtgtaactggattggctcccaccagcccagaagatttacgacgtgggaaatggtatacttggattaaaatatttcatccagatttgtttacatctagagagaaccccttgtaggttataaggaaactttttaacattcttccttgaatatattttctgtagctgaaaatgtttgtgaagtggctgtcaactacacatcgcatgagtagaggggctctgggtcggggtttcatatgcagcagagcagctcccttgctgccgtccatcaagagccctcaacacaagagtttgttataaatagaaataaacgacaaaaagtagaggggtatgtttaagtacactattagatgtgactgactaccttgaaacctgatttttttccatggggagaaacagtgcttgaattctgcatgccccccttgcatctagcaccttttggtaggggtggaaggagggtgtcagggagaatgattaggagataatggaggggaggggaaacttgcgttgtgtaatagcatttgaagagcactta

SEQ ID NO: 198979 - DNA, 1188 bp, Homo sapiens
  Payload ID: 19253
  Gene Name: VCP-interacting membrane selenoprotein
  Uniprot ID: Q9BQE4
  ENST ID: ENST00000526049
  CDS Start-End: 30-599
agggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacctctaactatta

SEQ ID NO: 198980 - DNA, 764 bp, Homo sapiens
  Payload ID: 19253
  Gene Name: VCP-interacting membrane selenoprotein
  ENST ID: ENST00000531964
  CDS Start-End: 28-528
gcgccgccacttttgcgacgcgcagccatgatggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagag

SEQ ID NO: 198981 - DNA, 655 bp, Homo sapiens
  Payload ID: 19253
  Gene Name: VCP-interacting membrane selenoprotein
  ENST ID: ENST00000528346
  CDS Start-End: 1-655
atgatgggtgggtcgtccgccgctgcaccgggcgccggagcctgggaggcctgggaacggtcgggcgttggcgcttacgcggaccttgggcagcaggcccggaccttgcgcggaggcttctcgggagccgcacttccctgggcggctcggctgtcccttgtttgcgcaagtcttttttgcgaaccaagcccttccttgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctg

SEQ ID NO: 198982 - DNA, 3880 bp, Homo sapiens
  Payload ID: 19254
  Gene Name: v-crk avian sarcoma virus CT10 oncogene homolog
  Uniprot ID: P46108
  ENST ID: ENST00000300574
  CDS Start-End: 142-1056
gggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggaggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaa

SEQ ID NO: 198983 - DNA, 3675 bp, Homo sapiens
  Payload ID: 19254
  Gene Name: v-crk avian sarcoma virus CT10 oncogene homolog
  Uniprot ID: P46108
  ENST ID: ENST00000398970
  CDS Start-End: 107-721
gctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggaggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaa

SEQ ID NO: 198984 - DNA, 1391 bp, Homo sapiens
  Payload ID: 19254
  Gene Name: v-crk avian sarcoma virus CT10 oncogene homolog
  ENST ID: ENST00000574295
  CDS Start-End: 33-704
cggcaccccagcgtttaggcgcggaggcagccatggcgggcaacttcgactcggaggagcggagtagctggtactgggggaggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcg

SEQ ID NO: 198985 - DNA, 5325 bp, Homo sapiens
  Payload ID: 19255
  Gene Name: v-crk avian sarcoma virus CT10 oncogene homolog-like
  Uniprot ID: P46109
  ENST ID: ENST00000354336
  CDS Start-End: 510-1421
cggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagc

SEQ ID NO: 198986 - DNA, 2037 bp, Homo sapiens
  Payload ID: 19255
  Gene Name: v-crk avian sarcoma virus CT10 oncogene homolog-like
  Uniprot ID: P46109
  ENST ID: ENST00000411769
  CDS Start-End: 502-1413
gaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcatagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggca

SEQ ID NO: 198987 - DNA, 2911 bp, Homo sapiens
  Payload ID: 19256
  Gene Name: VENT homeobox
  Uniprot ID: O95231
  ENST ID: ENST00000325980
  CDS Start-End: 512-1288
gggcaccggcctgactctcccaccccgaagcctgctcccaacctaagtccgccctgactctcccagcctgaagcctgctcgccctcgggtgtccgggctgggcacaggcgccagcgtccccctggagaggagaggtcgcccggcacctcccaggacaggcccaagtgggagtgggaccctcctaccttcctgcagcctcggcccgcggggtggggggttgggagagatgaaaggaggtgaccgatcccgaaccatcgcctctccattaaccagggcccgcagccccgcccctcccccagacatcgaggagccggggaggtgtgaacggcctcctttgtgcctctgaatcgaaggcaattaggcgctgcttatctgggcattagccgtgtatgcaaaccgggctcccgccccctcctcctgggcttataaacgccgccgcctggcgaggcccgaggtggatcctgcgcctggccagccccgcctggccttccctccggcccacctggccgccatgcgcctctcctcctccccacctcgtggcccgcagcagctctccagctttggctccgtggactggctctcccagagcagctgctcagggccgacccacacccccaggcctgccgacttctccctggggagcctccctggcccaggccagacatccggcgcccgggagccccctcaggccgtcagcatcaaggaggccgccgggtcctcaaatctgcctgcgccggagaggaccatggccgggttgagtaaggagccaaataccttgcgggccccccgtgtccgcacagccttcaccatggagcaggtccgcaccttggagggcgtcttccagcaccaccagtacctgagccctctggagcggaagaggctggccagggagatgcagctctcagaggtccagataaaaacctggtttcagaatcgccgcatgaaacacaaacggcaaatgcaggacccccagctgcacagccccttctcggggtctctccatgcgcccccagctttctactcaacgtcttctggccttgccaatggcctgcagctgctgtgcccttgggcacccctgtccgggccccaggctctgatgctgccccctggctccttctggggtctctgccaagtggcacaagaggccctggcatctgcgggagcttcctgctgcgggcagcctctggcgtcccacccccctaccccaggccggccttcgctgggaccagccctgtccacggggccccggggcctgtgtgctatgccacagacgggggatgcattttgaggaggcacctctgactcccacactcgcggtcttgctgatcgcacctggctcctacctggaggactcagttgttctgtttacatcctggtggcacctctcaccctgacccacacaaaggttctggagattactggagaatatatataaatatatatatgtacgtatatatgtaaatacacatatacgtatatataaatatatatatacatatgtgtgtgtatatatatatatatttttttttttttttttttttttgagacggagtgttgctctgtcacccaggctggagtgcaatgacgcaatctcggctcactgcaacctccgcctcctgggttcaagcgattctccagcctcagcctcccgagtagctgggattacagacacccgccaccacgcccggctaattttttctatttttagtagaaatggggtttcaccatgttagccaggctggtctcaaactcctgaccctgtgatccgcccgcctcggcctcccaaagtgctgggattacaggcatgagccactgcacccggccctgagaatatatttattaaagccacctcttcactgaaagttaccgaaagagtcggtttaggaaggaaacgaagggtcagtgaacagagtcaaatgcagaagtgggcttgtcatgggtagggctttcggcgtacgataaaaggatcatttgttttttaaaaggggttggaaaaactggttttccagttggaaacagtaaaggttgtaagctttgtgtgtacaaaagaaaacagggaatgcaggtgtgtttatagcgttgtggttcaagtccctcttaacaagaactccaaagctggaaagcaggagggaacaaaggtgaacatgaaggcgaggatgctggggccctgcagtgcgctctaggctgtgcgtgagccgggactgtacccacagcttgctgagggctgctcttcttgggccagggaaagcagggcagccgggacctgcggctgtgcctggactgaagctgtcccgcaggtccccaccctccaacacgtgctcacctgtccccctgctcgcagcagcctcgggacaaaacaatgactcaaggacagcacttcttgcagaaggtctggaagtgcccagaatgggaggcacggaagcccctcccggggaggactcccgcgttgatggaccgttcttggtgcagactcctgactgcgtgcatgaaacctgagacaagtgcaattccttccatgtcgccccagagtgcccaggaggcaggcagtgcggggtgcccaggcagacgggttcagcctgcagaactggaggcgacctgtgaaacccacccgggcaccccaacaggaacagaagcgtggtcctgcggctgcgtccccagcgagtttcactttccccttgctcgtttctcccttgttgtaagtgtttacaactggcatgtgcttttaaacgtcaggtaagaggggaacagctgctgtacatcgtcctggcgagtgacaatgtgacagaagcctgggcgaggccctcggagggcagcagctggacagggactactgggtttggcctggacagcactgatttgtggatgtggatgggggcacgttgtccgtgataaaagtacaagtgcccctcac

SEQ ID NO: 198988 - DNA, 4494 bp, Homo sapiens
  Payload ID: 19257
  Gene Name: ventral anterior homeobox 1
  Uniprot ID: Q5SQQ9
  ENST ID: ENST00000277905
  CDS Start-End: 246-806
accagactggccgcctctcggcgagcgcgccactctcccgtcgccgctgacccgcgcgcggccgccgaagcctccccgcggggacattcattcttgccccttgcctgtcgccgggccgggcgtacgggccgcgttgtcgggggttttgtcccctttttcctcttttttttttccttctccgccccccccccttttttttttttttgctttttttttcctttctgtttttgttgttgttcttgcctatgttcgggaaaccagacaaaatggacgttcgatgccactcggacgccgaggctgcccgggtctcgaagaacgcgcacaaggagagtcgggagagcaagggcgcggaggggaacctcccagccgccttcctcaaggagccgcagggcgccttctcagcgtcgggcgctgctgaggattgtaacaaaagtaaatccaattccgcagcggacccggattactgccgccggatcctggtccgagatgccaaggggtccatccgagagatcatcctgcccaagggcctggacttggaccggcctaagaggacgcgcacgtccttcaccgcggagcagctctatcggctggagatggagttccagcgctgccagtacgtggtgggccgcgagaggaccgagctcgcccggcagcttaacctctccgagacccaggcaaatagtgaagaaaataatgaacgattcaaacgcgggataaaaaaacaaaagaagaaaaggaagaaagagccagcaaatgatgagtctcggcgtggggactccgggggcagagggtggcagcccctatagtgcggggccctgcgactggtaccgtgagcgcctgggatgaggtttgggcggatttcgggtttccggagaggcagagacgcctggctacgacgatttgttccacttccttgagtgtttcgctctcgatttctctatctgtccctctgaggtcggcccctcagaccctcctccttaatttcccactgcgtaattcttagtttatttaggaactcatctctgggcactataaagtctctgcctcctaatgctaggtttctagagtcttccagctgcatcttcatgccggcagcattttggattttgtgcaatcatgggcccagaataggcaaggttttattttcttctgacttagaatataagtctcgccatcgtcaaagagaaactttgaaggagcaggagactgaaatcgatattaattcctgcaaagagacctcctcaccctggtgcttatgcggtggtgacgggtgtagacgttgcaaacaaatcttgggaagcgaggagggccggggaggacacttccggacacgctcttctaaagcgtgtgcagcacggggcgaagtccgcgctgcgggggcagcggccccggctccttcttgtagcgcctgcacacctgggtgttgcagggacccgcagctcccgtgcggcaccggccctagccaggccttactgcccctactcgtgtactgtgcctgaagctgaagttggaggcatccaaaataaggcggggcacagtgtgggcggcggagtccctgagccttgagctccgctttttgctgagatcacagcagccgcccacagacagttcacttttatttctcaaagttgctgcagatccctcagcttggcttctcttggctcttcccctccctgtccgcctctccttactttctcttgcttgaaactgcttttccttttctactcttttcttccgcgctcctgtcccgtaaacgcctgcgcttcctttaaggagttctctctctgtggtgtgggctcccctctcgttccccctgtctccctcctccattacttcttccttccaggtctctctctctcttttggttttctggtttttttctcctgctcaaggggtcccaaaggccaaggcagtgggtggctctcgctgcagcttcaaggctggtggctgggaccctccaggggtgagaaggaagggagaaggtggcataactttttggaacaaaagaaaacacaaaatcctagcttgggattcccaacaaattcagcctcctctcccaggggcctcagcctgggaagtcaccaagcagatccctccttccagcttcctgctctttctcctttttgctttcttacccctgaaagagggaaggacaagtcacctcataacttctgctctcacctcccttccctccctggctttgggaagagctgctgagctctttgcctgccactcagggagtgcaattgttcttaaagagcctcttctgcatagaaaaagaattgcaattttaatttaaaaacatttatagaaaattcatttaattttagtgactatcttcttttccctccttccccaagggcctccagtaagctgccttggtccctggaggcttctggcttccaactggagactcacaggccttggaggaggaggcaggtaccctctatgccaatagctgggcctgcctggggaaaggtggaaggagaaacagctgcaggaggggggagctgaaaggaatctgatgctcaggcctgcacaaagcaaccgccaaattgtttcagagcagaaaagaaaaagggagaaaacctcttagcaaagccctgtgagtttgggggtcaggttcaagaaagatgtgggaagtcacttggagagctaaacgggacacatgctcctatccacacttgcagttggtctaaccttcagccagaatgtattcataagtagcatttggcaaccctttatagtttacaaatagcattttacatacaccattctactattcctcatggtggctttgggaggtccagctccgttttaaagactcacacaggactgaagcaaataacttgctcaaagccacatagctgctcagaacccaagattgtaagctccccctagggccagaggcctctttctttcagtttttttctttcgtccccctttgacccctctttccttcttccctttctcccctccttcctcctttccttctttttgtgcccacagtgtctggatcatggtacctgaattctttagcctatttgcacccacatctgctaatgtccatatctagccatctattacaccagctgctgaggatttacttggtgccctcatcaagaagtttgaatttctccctccttcctttttttttcctgccactgtcccaactctttccctctacgtctctctagaatgacatctttaaaccccttacactctttggtcttacacatccttaaaaatgattatttataaattgaattataatatccatgaggtaaacactcatagggtaaagtacacaaagcttaactatacaagttgatgatttacacacacacacacacacacacacacacaccccttcttgaatggctccaaggatacccttttaacttcttcccttcagccacataagccatatgatgacacacagtgtctttctcctgtttgaaaagaaattgtgtcatattggtgtgctgttcttgcatagaaagccttttttaagaagtctttttaagatttcttgaaggattttagaaatcatatatctcttctaaccccctgaaatcctgagtttaagtggcttgattaaatggctgatcaaaacttaaaaacacactaggtcaatgtttttcaagatacaactgaggaccagctgcttcagaatcatctggggactggctaaaattccaggttcctaagccctagtcccatctgatgaatcagaaactaggttggggcttaggaacgtgcattttaaacacttttccaaagtgattcttatccagactaatatttgagaagtactgtattaaatggcaaactcccaaaacactgcagcctcctgcatctggcccagggcctggcatttggtaggaatacaatgaatgtttgttaaacaaattaatccacagtttctgacacagtttagaatttcttggaccacattatgctattgtaatttaacaccatttctacgtcgggaaatctttacatttcagtctttttcattttcatggaggtttcattttaatggagcaggagagaaaagagagatctactttggtggtttctcaggtctcagggaaggtcttttataaactcaatggggaccaccttcctggagaggctgctcccttacagacctggtagtttggggaaaggaggaggagagcccttcaggtttgctgaaaagcattcagatgcacacccttcttggttggaactgaaagcttctgtttgaagagacatgagttctggaaggagcaaggccaccaggtccagagaacctggcatgcaatggacatggaagctgaaaattacttgggtattctctgatttctagctaatatgaaaataattttctttctagaaacacatttgcctatcttcttaccctgaaacagaaaataaatattgtgctttatgtggtagtgttgtacccattcttaaaaataaatcacatcatatatatgtgtaaaatat

SEQ ID NO: 198989 - DNA, 1723 bp, Homo sapiens
  Payload ID: 19257
  Gene Name: ventral anterior homeobox 1
  Uniprot ID: Q5SQQ9
  ENST ID: ENST00000369206
  CDS Start-End: 1-1005
atgttcgggaaaccagacaaaatggacgttcgatgccactcggacgccgaggctgcccgggtctcgaagaacgcgcacaaggagagtcgggagagcaagggcgcggaggggaacctcccagccgccttcctcaaggagccgcagggcgccttctcagcgtcgggcgctgctgaggattgtaacaaaagtaaatccaattccgcagcggacccggattactgccgccggatcctggtccgagatgccaaggggtccatccgagagatcatcctgcccaagggcctggacttggaccggcctaagaggacgcgcacgtccttcaccgcggagcagctctatcggctggagatggagttccagcgctgccagtacgtggtgggccgcgagaggaccgagctcgcccggcagcttaacctctccgagacccaggtgaaggtctggttccagaaccggcgcaccaagcagaagaaggaccagggcaaggactcggagctacgctcggtggtgtcggagaccgcggccacgtgcagcgtgctacggctgctggagcagggccgcctgttgtcgccgcccggcctgcctgcgctgctgccgccttgcgccacgggcgctctcggctcagcgctgcgcgggcccagcttgccggccctgggcgcgggcgccgctgcaggctcggccgccgcagccgccgccgccgccccgggcccagcgggcgctgcatccccgcacccgccggctgtgggcggtgctccaggtcccgggcccgccgggccggggggattgcacgcaggcgccccggccgcgggccacagcctcttcagcctgccggtgccctcgctgctcggctccgtcgccagccgcctgtcctccgccccgttaacaatggctggttcgctagctgggaatttgcaagaactctccgcccgatatctgagctcctcggccttcgagccttactcccggaccaacaataaagaaggggccgagaaaaaagcgctggactgattttaagtgtttccctgtatttatatttatagtatctattgtggtgatatttatggactcacgcgcattaggtgcccagagctcctgcgctgggctcctggctcccaccaggcctctgacagctctcctttcccactagactctgctaccaatttcatctcattcgggctattttttttttctactacctttcctctgagattcctccccaacccccaacttccttctgaatccaggagcgatccaaagaattgggaaaaatgcccgagttagtcaacctgatgccctgaccccgtgcccagcccaggagggaaaagactggttctaactccaaagcacaggacgtttgctctagatccgcggctgctgcggctgctgccgctgccgactattcctaggaatatttgaaagaggaaaactgcgcgcagaccccaggggcttccaggtttctttagaccaaaaaaggaggacgttccttcctcttgccagggaaaccagggcttgtgggagcccctgggccccgctttgcggacctctcgggatagtcggtacacaacacagcttcctggcgggcaaatcctgcggtttttctcccctttagggcaactccaatcacaaccacccccgaccccaggaaacagtaacaaacgtcgtagtaggcaacgacactgataaatttgatctaatcagcaataaaagcaattgctacgtaaaacca

SEQ ID NO: 198990 - DNA, 1147 bp, Homo sapiens
  Payload ID: 19258
  Gene Name: ventral anterior homeobox 2
  Uniprot ID: Q9UIW0
  ENST ID: ENST00000234392
  CDS Start-End: 33-905
ccgccgtagaggggttggcagtggcggtcagcatgggcgatgggggcgccgagcgcgaccggggccccgcgcgccgggcggagtctggtggcggcggtgggcgctgcggagaccgcagcggagcgggggacttgcgagctgatggcggtggccacagcccaacggaggtggccgggacctcagcctccagtcccgcaggctccagggagagtggagccgacagcgacgggcagcccgggcccggcgaggcagaccactgccgccgcatactggtgcgagatgccaaagggacaattcgggaaattgtcctgcctaagggcctggacctggaccggcccaagcggacacgtacatccttcactgccgagcagctgtaccgcctggagatggagttccagcgctgccagtatgtggtgggccgcgagcgcactgagctggcccgccagctgaacctctccgagacccaggtgaaggtctggttccagaaccgccgcaccaagcagaagaaagaccagagcagagacctggagaagcgggcgtcctcctcagcctccgaggcctttgccacctccaacattctgcggctgctggagcagggccggctgctctctgtgcccagggcccctagcctcctggcgctgacccctagcctgccaggcctacctgccagccacaggggcacctccttaggtgaccccaggaactcctccccacgcctcaacccgctgtcctcggcctcagcgtcccccccactgccgccccctctgccagctgtctgcttttcctcggccccgctcctggatctgcctgccggctacgaactgggttcctcggccttcgagccatacagctggctagaacggaaagtgggcagcgccagcagctgcaagaaagctaacacttaagactcccaccctgtgacactgagtcccgagcacagcaccttcccagtctcctgtgccccagcggacagcactgagcaggccccggagaggaggggctgcagccacacactcttccccacctgccccccagctcagagactcgtgaccaaatggccttggtcccgcagcttgtgtgcgtgagtgcagtgtgagtgtgtgtgtctctcactgaaataaaaggaaaacaatgacaagaagggaaa

SEQ ID NO: 198991 - DNA, 4202 bp, Homo sapiens
  Payload ID: 19259
  Gene Name: ventricular zone expressed PH domain-containing 1
  Uniprot ID: Q14D04
  ENST ID: ENST00000362010
  CDS Start-End: 309-2810
ggcagctcagggagacgcggctgcagcccacaggactgggcagcagctgcaaggctgcctctgagcatggtcatgggtcccagctgcagtgctctaaagatcaaggattttgccttctattttctatgaccagagattcctgtgcaaagagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaa

SEQ ID NO: 198992 - DNA, 3044 bp, Homo sapiens
  Payload ID: 19259
  Gene Name: ventricular zone expressed PH domain-containing 1
  Uniprot ID: Q14D04
  ENST ID: ENST00000392832
  CDS Start-End: 318-2819
attcttccacccggcaccggctccgcaatgaacaacttcaggttcactgagctgagcggattccactcgctgtgccctcggagcctgcctgaatctcccgcccagtctcaaaccatgcagctgagtaactgcaagggcgcctttgaggagtagcacgcagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaat

SEQ ID NO: 198993 - DNA, 3979 bp, Homo sapiens
  Payload ID: 19259
  Gene Name: ventricular zone expressed PH domain-containing 1
  Uniprot ID: Q14D04
  ENST ID: ENST00000392833
  CDS Start-End: 221-2587
gtgctctaaagatcaaggattttgccttctattttctatgaccagagattcctgtgcaaagagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaa

SEQ ID NO: 198994 - DNA, 730 bp, Homo sapiens
  Payload ID: 19259
  Gene Name: ventricular zone expressed PH domain-containing 1
  ENST ID: ENST00000461299
  CDS Start-End: 543-730
tggatgcaattgtttaggagaagagtgaaggagaagagaagagagcccgaaactaaacagggaggaatccaccatttagaagtctggcaggcaaagaggacaaggctttgtgtttcacctcaggaaacagagcgttgcactgggaggtaactccgctgggtgaggtgcagcctgtcacctgaccggtctctggggctgccggtggcatcaggctgcattccttgaattcttccacccggcaccggctccgcaatgaacaacttcaggttcactgagctgagcggattccactcgctgtgccctcggagcctgcctgaatctcccgcccagtctcaaaccatgcagctgagtaactgcaagggcgcctttgaggagtagcacgcagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcac

SEQ ID NO: 198995 - DNA, 1401 bp, Homo sapiens
  Payload ID: 19259
  Gene Name: ventricular zone expressed PH domain-containing 1
  Uniprot ID: Q14D04
  ENST ID: ENST00000468233
  CDS Start-End: 314-955
ggttgttaggcaaatctaattctttcaaactacagatctgctcagagaaatctgtaaatctagtgtagaaataagtgaagctttgcgtcaattgttaggtctaagcagaagtttgggagagagaagaaaagttactcatttgcctgattccgcacgagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtatggtgcgaaagttgagcttggggacatgttttgggagatatttaaaagtattttcatcaagcatttatggtttgtgggaagcaagacctagagtattagaagcaaattaatttctctgttttgctgccagttgacctgtgaacatgcaaaaggttacttaatctggctgtctgtgtcccttcccaaggcagatgaattacttagactcattaaaagaattgtaagcattcttccaaatctgtgtttctcagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaa

SEQ ID NO: 198996 - DNA, 557 bp, Homo sapiens
  Payload ID: 19259
  Gene Name: ventricular zone expressed PH domain-containing 1
  ENST ID: ENST00000489602
  CDS Start-End: 392-557
gatgcaattgtttaggagaagagtgaaggagaagagaagagagcccgaaactaaacagggaggaatccaccatttagaagtctggcaggcaaagaggacaaggtgtaatatctggttgctgttgccattctgccaccaagaaacctgatgacttcatttgggcctcttcaaccagctgcccctaaagctagcaagctccacccttcagtgtccactgataaattccttaatagcagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccagg

SEQ ID NO: 198997 - DNA, 582 bp, Homo sapiens
  Payload ID: 19259
  Gene Name: ventricular zone expressed PH domain-containing 1
  ENST ID: ENST00000475050
  CDS Start-End: 261-419
ggatgcaattgtttaggagaagagtgaaggagaagagaagagagcccgaaactaaacagggaggaatccaccatttagaagtctggcaggcaaagaggacaagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcatctgtggaaaggcaagagtgaaatcagaaaggccagttgagtggctactgaaataattcagataagaagaagcagaggttctgaccatcatggagcagtggtggtggattaccaaaccaataacaatgaccaggcagtagttgaaatctgtatcacaagaatcacaacagccatcagagagacc

SEQ ID NO: 198998 - DNA, 715 bp, Homo sapiens
  Payload ID: 19259
  Gene Name: ventricular zone expressed PH domain-containing 1
  ENST ID: ENST00000473907
  CDS Start-End: 254-463
attgtttaggagaagagtgaaggagaagagaagagagcccgaaactaaacagggaggaatccaccatttagaagtctggcaggcaaagaggacaagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcaaaacgtagaacaggaagggatcgtctaaattgccccttccaacttccagcacagaagattgctgaaaaataggtggcttctcctgcacttgcaatgatgcgaatatgtctgtggaaaggcaagagtgaaatcagaaaggccagttgagtggctactgaaataattcagataagaagaagcagaggttctgaccatcatggagcagtggtggtggattaccaaaccaataacaatgaccaggcagtagttgaaatctgtatcacaagaatcacaacagccatcagagagaccgagtccattgaaaagcatgcaaaggcccttgtg

SEQ ID NO: 198999 - DNA, 665 bp, Homo sapiens
  Payload ID: 19259
  Gene Name: ventricular zone expressed PH domain-containing 1
  ENST ID: ENST00000479987
  CDS Start-End: 306-665
aagtggatgcaattgtttaggagaagagtgaaggagaagagaagagagcccgaaactaaacagggaggaatccaccatttagaagtctggcaggcaaagaggacaaggattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgag

SEQ ID NO: 199000 - DNA, 1714 bp, Homo sapiens
  Payload ID: 19259
  Gene Name: ventricular zone expressed PH domain-containing 1
  Uniprot ID: Q14D04
  ENST ID: ENST00000494677
  CDS Start-End: 524-1165
tgtaaatctagtgtagaaataagtgaagctttgcgtcaattgttaggtctaagcagaagtttgggagagagaagaaaagttactcatttgcctgattccgcacggaaacagagcgttgcactgggaggtaactccgctgggtgaggtgcagcctgtcacctgaccggtctctggggctgccggtggcatcaggctgcattccttgaattcttccacccggcaccggctccgcaatgaacaacttcaggttcactgagctgagcggattccactcgctgtgccctcggagcctgcctgaatctcccgcccagtctcaaaccatgcagctgagtaactgcaagggcgcctttgaggagtagcacgcagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtatggtgcgaaagttgagcttggggacatgttttgggagatatttaaaagtattttcatcaagcatttatggtttgtgggaagcaagacctagagtattagaagcaaattaatttctctgttttgctgccagttgacctgtgaacatgcaaaaggttacttaatctggctgtctgtgtcccttcccaaggcagatgaattacttagactcattaaaagaattgtaagcattcttccaaatctgtgtttctcagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaatattctccttgtcttcttttattttctttggtttcagatcaatcaaaaaacatgtttttgaacttgaagtcagagaacaatacatgatattaattgatgtgca

SEQ ID NO: 199001 - DNA, 746 bp, Homo sapiens
  Payload ID: 19259
  Gene Name: ventricular zone expressed PH domain-containing 1
  ENST ID: ENST00000487753
  CDS Start-End: 252-746
tgtttaggagaagagtgaaggagaagagaagagagcccgaaactaaacagggaggaatccaccatttagaagtctggcaggcaaagaggacaagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgat

SEQ ID NO: 199002 - DNA, 992 bp, Homo sapiens
  Payload ID: 19259
  Gene Name: ventricular zone expressed PH domain-containing 1
  Uniprot ID: Q14D04
  ENST ID: ENST00000537559
  CDS Start-End: 158-691
agagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaat

SEQ ID NO: 199003 - DNA, 12625 bp, Homo sapiens
  Payload ID: 19260
  Gene Name: versican
  Uniprot ID: P13611
  ENST ID: ENST00000265077
  CDS Start-End: 566-10756
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 199004 - DNA, 9455 bp, Homo sapiens
  Payload ID: 19260
  Gene Name: versican
  Uniprot ID: P13611
  ENST ID: ENST00000343200
  CDS Start-End: 357-7586
cttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 199005 - DNA, 7154 bp, Homo sapiens
  Payload ID: 19260
  Gene Name: versican
  Uniprot ID: P13611
  ENST ID: ENST00000342785
  CDS Start-End: 357-5285
cttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 199006 - DNA, 2087 bp, Homo sapiens
  Payload ID: 19260
  Gene Name: versican
  Uniprot ID: P13611
  ENST ID: ENST00000502527
  CDS Start-End: 106-2073
caccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcg

SEQ ID NO: 199007 - DNA, 5923 bp, Homo sapiens
  Payload ID: 19260
  Gene Name: versican
  ENST ID: ENST00000512590
  CDS Start-End: 411-5195
gctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccagg

SEQ ID NO: 199008 - DNA, 3973 bp, Homo sapiens
  Payload ID: 19260
  Gene Name: versican
  ENST ID: ENST00000513960
  CDS Start-End: 254-3973
tttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatc

SEQ ID NO: 199009 - DNA, 1825 bp, Homo sapiens
  Payload ID: 19260
  Gene Name: versican
  ENST ID: ENST00000513984
  CDS Start-End: 240-1304
ctccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtaagtgtttgatacctttttaaaaattacagttttaaaaaaaatgcttcgaagcatgcattgatgttcaactagccgttggagtggattccatgtcttgcagtgtgtgcacggaatggaaacagttcagtgattttcaaaagcaagcaaactgaacagcagtgatatggttaaaaccacaggaattttggcaaatggatttttagaggggtgaggaaatatcaggttaagctgtaactgtgctctgttgtgtccagagccacagagcatttttctaagtattttatattaattgcagtccttaagttttgcaatttgtttattggtgttacaatgccaaggccaactgaggctgagttaaatccttaagattgttgattttgtcttcggtatcactctgtttctttgagatggcaaagaatttaaatttcagtaattacaggtgagtatttgaagctgacatggatactcaaaatgttcaagtcataactaaaaatgaaccatactatcaataaaaatctccatttatgtcaagtaatggaaa

SEQ ID NO: 199010 - DNA, 3466 bp, Homo sapiens
  Payload ID: 19261
  Gene Name: vertebrae development associated
  Uniprot ID: Q9H8Y1
  ENST ID: ENST00000256362
  CDS Start-End: 242-2350
gcacttgagggtgggcgatttcctggggggagtggcttaagccgcttccccaccggccagttggctgtagacggtccatgctcaatggtcctctacagatatgaaactggttctggagtgagacgagctcggctggggacgctacttgagaaggcctttccccacagggtgacttaaatgtcccaggctggaaggtggagcgagaagtggatgcccccagggctctgggtcacactccaggatgacttctcggaaccagctggtgcagaaggtgctgcaggagctgcaggaagcagtggagtgcgaaggcctggagggtctcataggtgcttccttggaggccaagcaggtcctgtcttccttcactctccccacctgccgggagggaggccctggcctccaggtgctggaagtggactcggtggccctgagcctgtatccagaagatgctccacggaacatgctgccgctggtgtgcaagggggagggcagcctgctgttcgaggcggccagcatgctgctgtggggtgacgcaggcctcagcctggagctgcgggcccgcaccgtggtagagatgctgctgcacagacactactacctccagggcatgatcgactccaaagtgatgctgcaggccgtgcgctactccctatgctctgaggagtcccctgagatgaccagcttgccccccgccacgctggaggccatcttcgatgccgacgtcaaggcctcctgtttccccagcagcttctccaacgtgtggcacttgtatgctctcgcctctgtcctccagcggaacatctactccatctaccccatgcgcaacctcaagatccggccctacttcaaccgtgtcatccggccccgccgctgcgaccacgtgccctccacgctgcacatcatgtgggctggccagcccctcaccagccacttcttccgccaccagtactttgcccctgtggtggggctggaagaggtggaggctgaaggtgcccctggcgtggccccagctcttccagccctggccccactctcatcgccggccaagaccctggagctgctcaaccgtgaacctggcctcagctactctcacctctgtgagcgctacagcgtcaccaaaagcaccttctaccgctggcggcggcagtcccaggagcaccggcagaaggttgctgcccgcttctccgccaagcacttcctgcaggacagcttccaccgggggggcgtcgtgccacttcagcagttcctccagcggttcccggagatctcccgctcaacctactatgcctggaagcatgagctgctgggctctggcacctgcccggccttgccccccagggaggtgctgggcatggaggagctagagaagctgccggaggagcaggtggctgaggaggagctggagtgctccgcactggcggtgtcaagccctggaatggtcttaatgcagcgggccaagttgtacctggagcattgcatctccctgaacacactggtaccctatcgctgcttcaaacgcaggttccctggcatctcacggtccacttattataattggcggcgaaaggccctccggaggaaccccagcttcaagccggcaccagccctctctgctgctgggactccccagctagcatctgttggggaaggggctgtaattccttggaagagtgaggcggaagagggggcagggaatgccacaggtgaggaccctcccgcccccggggagctcctgccactaaggatgcccctgtcccgttggcagaggcgtctgcgcagggctgcccgcaggcaggtgctgagtgggcatctccctttctgccgcttccgcctccgctaccccagcctgtcaccttctgccttttgggtctggaagagtcttgctcggggttggcccagaggcctgtccaaacttcaggtgccggtccccaccttgggcaaaggggggcaggaggctgaggagaagcaggagaaggaggctggcagggatgtgacagctgtgatggccccacctgtgggggcttcttcagaagatgtagagggagggccttccagagagggggccctgcaggagggggccacagcccagggccagccccacagtgggcccttgctgagccaacctgtggtggcagcagcgggtggcagggatggccggatgctggtgatggacatgatcgctaccacgaagttcaaggcccaggccaagctgttcttgcagaagcgcttccagtccaagagctttccctcctacaaggagttcagtgccctctttcccctcactgcccgctccacatactacatgtggaagcgagccctctatgacggcctgaccctggtagatggctgacagggaggtacaaaaggggctgggaagaagggggaccagtttggagagggtcagggacctgagctgaccccaggcttggccaggatgtcctttgctctgggtcccacagtgtctaccctaagtccaagggtatatttgtgttattttctggctccaggacagagaatgccagaaatcagccatctggtctcccgtaggaaactgtgggaccagagatatcctctttcgttgtttgctggtcatatttttactgttatgatttagtttttggttttgatttgagtgggttggttggcccccttgctggagttggaagccgtatgtatgtcagggggtttagaggggggttggttagctagagctgctttcagcttttcctggagacaaaaggagtgttatagcatgatcatcggtcccactgggcagaacgttatcttcagtttcttttgggggttggcatcctctttactcagttgtttcccaaaggaacattaggctcgaatatgggggccaggtgtggtggcttatgcctgtaatcctagcgctttgggaggccaaggcaggaggatcacttgaggctaggagttagagaccaccctgggcaatgtagtgagacctcatctcttagaaaaaaaaaaagaaagaaaatcaaatgtagagctgatcagcagcttgtgcctggcatccccaagggagaaggtgccaggtcagcaggagcagcagcagggatgtatagaaagaaccacagctggcctctaaaggatggcactgaggcaccggagatcttgaggcactggagatcactgaggggctggcctgtcccctgcaaggagtgtgggaccaggtggggcaaggctgggagatgcaggctctgtttgcagattatggcccagagtctctgcttgtgggtgcttgatccacctgctgggaccctgcagtcctcggccagcctggctgtcagttggggattccacctttctgctgagcgtcttctcggagctggaggcccatcttcagtgagagatcacaaagcggccaggcaggtgggagactgaatttgccttgttcgagagtaacgtttgaaaaccaaagaaataaagtgatgcagtgcccaca

SEQ ID NO: 199011 - DNA, 521 bp, Homo sapiens
  Payload ID: 19261
  Gene Name: vertebrae development associated
  ENST ID: ENST00000557177
  CDS Start-End: 272-521
aaaagtaccagagagtggactcggctgacccggcggctacagcgcccccatattttctgggagacttcccttttgacaataggtatccgagagtgtaactactttatggtacgtttcctgaggacagctgctctgtgaagcccactgccccaaaggcacctatcaaagaccctgcaaacaagcagatggcaatccaggttgccaatgacattgcccatcccaggtacctgggctgcctgcttttccctgaagtgggagcctggcttgcaggatgacttctcggaaccagctggtgcagaaggtgctgcaggagctgcaggaagcagtggagtgcgaaggcctggagggtctcataggtgcttccttggaggccaagcaggtcctgtcttccttcactctccccacctgccgggagggaggccctggcctccaggtgctggaagtggactcggtggccctgagcctgtatccagaagatgctccacggaacatgctgccgctggtgtgcaagggggagggca

SEQ ID NO: 199012 - DNA, 736 bp, Homo sapiens
  Payload ID: 19262
  Gene Name: very low density lipoprotein receptor
  ENST ID: ENST00000382096
  CDS Start-End: 216-736
ggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccgcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatga

SEQ ID NO: 199013 - DNA, 3240 bp, Homo sapiens
  Payload ID: 19262
  Gene Name: very low density lipoprotein receptor
  Uniprot ID: P98155
  ENST ID: ENST00000382099
  CDS Start-End: 91-2628
cttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaaggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaa

SEQ ID NO: 199014 - DNA, 9163 bp, Homo sapiens
  Payload ID: 19262
  Gene Name: very low density lipoprotein receptor
  Uniprot ID: P98155
  ENST ID: ENST00000382100
  CDS Start-End: 357-2978
ctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatggtttgtgcctgttcctctaggatgaactcctatcctgagtagtaccaagtgttctaactaaatgtgtgagctgtagttcttgatgttgtataactaagcctgtaattgggctggtttctcttacaccctagcacagttaaaaaatgaagtactgtttaacatttgctcccgaaatatttcttactgtgtaaaagaagctagcttagtctgtacctagaattcctcttggttagaggagtgagtttcttttttttccattaacttgtttcctgatcgagaaacacgtgctaagatttctatgaattctgcttctttatagttaagtctctgttttccatgttctgtcatttatataggtcaaggacaagtgccttctaaggcatggataagggctttcttcttatgaaagtctagactgtcttactgtgaagatggccagggaggatagcaagcaatggcattcttgaacagtctaaggcaggtttctcagtgtggtcctgagaacagaagcatctgcatcacctgggaatgtattagaaatgcaagttcccagccccatcccagacctactgaatcagaaactctgggggcgagggctgaaacctgctttcataagcccttcaggcgatactgatgtaaactaaagcttaaaaaccaccgttttactgtgacttcatgaagaatataattgcaatatcacctaaatttttatcctggctgggatggggcagattcttactatggacaatttctggaacttacagtatgaagagcagatgaggagtttgagacaaagaaaaaattgtacagggagtttagtgaattttccatcaggttggccattactttctttctctaaagtctcaggatgtctggaagcaaggaaagacaaaagacttgaagcaccgggtgcatgctgtgtgtcacaagtgaggtggagagttggctgtggaaggtacagcaattcctctggaattaaatgaccgaccaacacagtaccaagaggatgaagagaagatgttttgcgttgctacgtgaatcagtggatgactcatatttcacttgcatatgaaatataaggcagttaacatcttgtttgtggcttaagcaaggacattaatcctactagatgaaggggaagttggttctgttgtcttaagggatgcccccttgtgattttggtcaactgaatgaaaaagaaaagatagccttggacttttttttcatgggaggtttggaggtcaagcatgtagaaggaaaaggctgtagtcatgaatatagaactgtctgctctccaccttttcctcactctacatttagtcatcacactgaacaggatgtggcctgctgacagtgagtagctgaagtgcctgtttggtaagtaggttagcattcatcatgaactctgaaagccatttcagagtttggctgctgctctgaccctgctgtggtacaaaaaacatggatttttttttttttaactggagtaataccaaattccctttagaagcttgaagtttgatactattgctttccccattataaggattatacagtattaattaattataaggcccaaagtttgttttggcaaataaagtattattctctatcatcatcttttgaattcctgtccctagtatgttctttcatgttctgggtaaaatttccaaccctcaaagagtctaaaacgtctcatttttttttaccacgtcctccccagtaagaagccaaggtacaactcattgtacctacgaggtacaaactcatttgtagaaacaaagtaactagatattcctattgaaataagaatagatatattggtgggccaggcatggtggctcacgcctataatcccagcactttggaaggccaaggcaggaggatcacttgaggccaggagttcgagaccagcctgagcaacatggtgagaccctgtctctacaaaaaaaaaatttataaaaataaaagaaaaaaatagttatatgactaaactactagtcaatacagcttgcaataatagtgcatgaatgataacaggcctcggctttatcacccaaaaaataacttgaattctatgtgaaatgtgttaggataagtttgctctgtctctagagttcaatgtagaagataattaagaggtaaaatatgaagcttatcatacactaaaggagaatatttggagttagatgagcctgtcacacaaagtgaaagtggaccctccagaaattttaggaattgccacaaagattgatgatagatgaataaacagatttgtggcctctggtaaagaaatccagccaagttcctctgtccaaatttttaagtgccctttgcaagctaatctatttggcaaaaaaatagtcccagttgttcaactagctcccttaaaacattctagtaggtgttttaaagcctaggtatcgctgcctctttagttcttgatgaatacaaggcaaaaaaaaaaaaaaaaaaaaaaaaaaaattgaggctttcactttggcatttgcttctgttccttgtatctgtggaagtcaagtagcccttctcaaaaatgagaagccaagctttaaatagcaaactacagggtattaaaagactaactcttcagttaagaacactgtagaaatggtagaccaacttaaagtctaccttttaacaatctttaccccaaacctaaagattctaggggtcacttatctctattacgtaatctaactggaataatttcctagaattcttactagtgaaatcttacccaagtaaaacaatttattattttgaatccaaatgaaagctatactgtttgctttcaatggtggcaaaaacttgcaaaaagcagatatacttttgctaatttaagttgaagtactatgaatacaacctgctaatcttgatccccaaatctgagcccttcagtttcataattgttttatcctgaacgtagttgtgacatagacatttctcaaaagggtctgatacatcaaactcctaacaagtaggagcagcaactagctaaagagtagaaagaagcttcccttattgtgggtgatgaggcggtgcctaaaaaccacatatatataatcccctgggtattacatattctgcaagccctgttagtggggagatggtagtggcaatagcagcgatagttgcgtcagtgctaactgctgctgctgcccgttctgttggcggctgctggccaagtgtgcacacttagccctggttgaggtgcattgtctgctgtcgtctgttaagcatctaaccggagtgggagggcacatcaagcgatttcactctcttaaagaaaaggtttttaggtatttttggtattatatagtctctaaggccagaaggggcttataatgacttctcttctagaattgtaatactaaaaaactactcgagtaaatatcctaacaagtatgatttttcttgggaaaactaaaaattgtacatccatgcttcagccatatcatgggcctaaactatgagagttcagaaatatataaaagtacaaaaatcttcaaaggtacttatttccaaatatggagggaatgaatctgaagagggaacaatggcgtttttcgaacttatttctctctaatccagcctggaggatttttagccgaaacagttgcatgtgaaggattatcagccatctttgcatatccctttcacatctaccttcacacaggaaagctgaatgcattttaccagtgaggctctagatatgaaacttagggatccatagataaataagctactaacaaactgataacagtggtgttccatctctctatcatgtctcctgagtccgtttcacgtttttgagcctggctaatgagaaaaagaacaaagtaggaccatgacccagtgttctcctgtaaatctcactgtaaaaatctcaatgcaaaaacactgagacaggagtgagaccagctgcgggtggggagtttgtgctccgcaggttacctcatggcatatcaaaaatggcttttttcttcactgcgctcaaggaaaaagtcagatgggtgacaaggtggttctgtttagaagcagcaggcaatgtagttaacagcatagacttccgtgtcttgtgtgtggtaccttgggcaagttactaactccctctgtaaagtagagacgatggggactgtctcactgtgacaaggtaagatttaagtgagatgcacacaaaaagctcagcacagtgtctggcatctaatatgtgcagggcagatgtcactactgaatatcacatcaatgctagggctgtatttactgtcacacacaggcaccggtaagtgactttaccggtgaaagtcacaggtacctttatctatgatgaatgtaatgtgttagatggtgaccgaagtgttctccactacacctgtctgaagagatctaagtctgatatttaaggagtgatagcatcttgcatacttaagaaggcttaaaagactgcatggtttaaaccctagaaacataaatggaatgtttctgcctcagttcttttgactacctcctaggacatggaaacaaatatttgggagcctgcatagtctttagatggctgccaaagcacttaaaatctcctttaaattcttaccatatgcttacttttgtactaagtaagtgctcccaagtcttttacttgctcttcacagcaaccctaataggtatctccattttacataggtaaaaactgaggctacaaacaatctatggttccaaatcctatgtgcttactgccgtcttctcttagaaggggatgcagtactgtacaaagattgagctggatgtcgcattgcatgtttgctgagtcctcctcattgctgatgttaggatccttcaacagtttctcagatgccagctatggctggcatccagtatggtggtgtaatggaagtgtactactagcactactacatcaggtcagcacagattaactcagttacgtgttataccttcaagacgctagacattccagaattattttccttggccatccaagtgaagtagaagtagattgttggattgcaaagaaaatgataaagattccctaaaggaatttataagcaggcaacttcattcctatgtataagatattgggagaaaacaaactgtaccacaacaaatcttaagtttcaaggctctcctatagggagaaacatggccaaaaagacaggaagaactgtggcttgtaactcaatgatgctataactccagcactggatcttaagtattctggaatataccagattggtagaactaccagacttgggtatttctcagttaacacacatgcaaggaggaagagagtttttttgaacaaaatgactggctttgacaaaactatcttgctctttttaaatgtcacttgatactagaatgcgatttaaaagcatgtaatgcctcaggagtccggcatatacaaccaaattatcatgctcaggatcttcagaattctaaaggcacatgttagaatgcagagtcctgatgacctgtcaataaacttttttttactaatgaactgtacatttaaataaaagtttatttttggga

SEQ ID NO: 199015 - DNA, 1284 bp, Homo sapiens
  Payload ID: 19263
  Gene Name: vesicle (multivesicular body) trafficking 1
  ENST ID: ENST00000367621
  CDS Start-End: 111-860
gcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaata

SEQ ID NO: 199016 - DNA, 7028 bp, Homo sapiens
  Payload ID: 19263
  Gene Name: vesicle (multivesicular body) trafficking 1
  Uniprot ID: Q9NP79
  ENST ID: ENST00000367630
  CDS Start-End: 59-982
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgtaacagtaggattagcaattttcatttattccttccatatatatttactgaatggctactatatgcctggtattgttctttgaaagcagaaacagcaggaaaaaaagtccctccctcatagagtttacattctaaaagggaggaaatagataataaaatatacattacatttaatcagtggctctccgagtgtgattagaaatacaaattttgggccccacctgtcctacccaatcagaaactctagggatgggtcccagccttctgagttttaagagacacttaaggtggtccctaaagttcgagtggtttagctctacccaaatcagaaatattgcaagtctgagaaaagagattctcctcaaaccggttctcaaaggtgtctctggacgaccggcatcagcatcacctgcgaacttgctagaaagttctggggaccacactatgggaacttctgtattaaatagtgataaatgctatggaggaaacattgaggacaggataggagatgcttaggtgtgtacagacatatgcatatttcaatagaatagccaggatagacctccctgaggtaacatttgagcaaagaaggaaaagagtaactagtatgcagatacatacatggaggaagagcattcccaacaggtagacagaaatcaggtcagagggtaaaagcaggagaaaggctggtgagggagctaaaagcttaggatcataaagcttttttgtaagacacttgactgggagctatatggaaaggttttcagaagaaacgtagcctgatgtgacttaacttttgaaataatcatattggctcctatgttgagaatagaccgtaaggtgggtggtaagtaagggaggaagctgggagaccagttaaaaagagtattaacaataggccgggggcggtggttcgcacctgcaatcccagcactttgggagccaaggcaggcggatcatctgaggtcaggagtatatatttattaatatataaatatgtatttatatataaatcataaatatattaataaatatataatatatatattagcctggcatggtggcacatacctctaatctcagctactgaagaggctgaggcaggagaatcgcttgaacccaggaggcggaggttgcagtgagccgagatcgtgccactgcactccagcctgggcgacagagcgagactccttctcaaaaaaaaaaaaagtattacaataatcaaggtgagatattatgatgtcttagtccaggagtagccttggaggtaataaaacgggattggtttctggcggcttttttttaggtagagccacaggatttctgtaaactggatgtgaggtacgaacataagagaaggagtaaaggttgactccagatttttcacctgaatgcctgaaaggaatgagtaatcatgtactgcagtagggaaagttgccgaattcctctctcacttagactgaagtacaatgtttccaagtttttgtgaccagcccaagtgaaactgataacggtgttttgtcaatgcggcagagggagaagaagaaataaggttctgctgacaatgattgccacagatatctcaccaaatcactgctgaactggagctgcaagccaagaatagttcccatggttagcatggcctaggaagtttactgacatcaggactacaccaagaaaaagactccagttatgggtcttgaaaattaatatcctcagatgtttttagaatttatatatgacttgtaattctagaaatttgagaattctatgtatgcattgaaagattatatactgtcttttctaaagaaacaccctaatagcagcattgtacaaatattttcaactctaaaagaataatagctaatggagttgatgggttttggttttcatatgagaagtatccttccctggttggttgtaatctttgaagtctatgtggaattctaagactgcaggcttgttcattggagtacacttaagtaggacaaattctaagtaagcaacacttcaataataatcataatagctaacatttcaatgtttactaaatgtcagatactattctaagtattttgcatatattaattcatttaatcttcacagtggtcctgagaggtaggctttatttctgttttaagatgaggaaagggagccacagagtaacaaatttgcctaaggtaacacagctaatatttatttctaagctcagactgcctgtttcagatcataagaagtatcatccatgtcagtaagtcacctgttacattgtaagtacaatgagatgttatgagttccacattatcaaggtcattggacagttccttttattagtgaggtgttagcacctaaatttttctattatctgggccatatgttccaattgacagtgctaggcagtgaacacagggtatgaacttgaaaatctgattgcaccctcaatatctggaatatacactgatctatgacctgaaattgtatggactgcagcaatccaaggggacactaagcagggtttgagtaatgctacaatggatttataggtcattttggagaaggtgttccacatcattagggagtctgggtttcccagatgtgcctgttttatcctttttattttaaataacatcactgtctttcctaactaaaaattcttcatcttcaggaaataagattgagatacggactgaaaatataaaattagcaataatgtttattattagatacttcctcaattaaatttctccctgaaagtcttaggcaaaagcccctgtctcttacttcatatatcaagtttggagggaaagacataattgcatagcagtattccatgaatataacttaatggggaactggcttcagagttcagcaatattgggaagtcttgtcaaatattaagtcattcatatgttcaaaaatattaatatgtattgagcatctaccatcaaatatttaatatgataatgccatactggatattatatacgagttacaataattcttcctaaagtcagggaaagcttcacagataaggttgagctgaaggtttggcaggcagggaagcaaggagaagttagcagagagaaaagcacaagcaacaccatggaggaacaaatgtgggcaattcaggtaactcgagtaatttagtgttactatgcatatggcctatggaggccaggagtgtaaatgtattatggctggggcggggggctagggaatgtgttatgactaaattgtatcccttcagaattcatattttgaagcactgatctccagtgtgtctgtgttcagaggcaggtcccatagggaggcaattaaggttacatgagatcataaaggtgaggccctaatcctataggtctgctgtcattacaagaagaggaagagccaccggagctggctcattctgcacgtgtacagagaagaggccatgtgaggacacgcagaggctcgaatatgctctcaaccctatcagttgcctgctttaattcatcccatggaattgttttgtcttttcgacccctcggctatgttatttgtattgtgatataggggatattcggagtcctctgagacgggacaaggacactggacggtctattgtgccatgcttatatattttctgtatacaatgctttctgtataaaaccagtaatacctgagaaacaacagtaacttgacaaaattactattgatcacttaactttatgtatcacgtaagttaaactttatttatttacatgtgtctccctcattagatgctaagttccttgatattttatacatttgtgaattcctggtaattcacatgaagcttgatgcattgtaagtattctgacctggtgaaataaatatacgaatgggcaaaaaaatatatactaaaatgatcaaataaaggttgtgttcagaaacctc

SEQ ID NO: 199017 - DNA, 3177 bp, Homo sapiens
  Payload ID: 19263
  Gene Name: vesicle (multivesicular body) trafficking 1
  Uniprot ID: Q9NP79
  ENST ID: ENST00000452973
  CDS Start-End: 206-874
acttgacgtcgctgagcaacggaagagtgggcagcatttgctctgaacgctcgtgcgcgctaccgcccagacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgtaacagtaggattagcaattttcatttattccttccatatatatttactgaatggctactatatgcctggtattgttctttgaaagcagaaacagcaggaaaaaaagtccctccctcatagagtttacattctaaaagggaggaaatagataataaaatatacattacattt

SEQ ID NO: 199018 - DNA, 3272 bp, Homo sapiens
  Payload ID: 19263
  Gene Name: vesicle (multivesicular body) trafficking 1
  ENST ID: ENST00000620996
  CDS Start-End: 127-969
acttgacgtcgctgagcaacggaagagtgggcagcatttgctctgaacgctcgtgcgcgctaccgcccagacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgtaacagtaggattagcaattttcatttattccttccatatatatttactgaatggctactatatgcctggtattgttctttgaaagcagaaacagcaggaaaaaaagtccctccctcatagagtttacattctaaaagggaggaaatagataataaaatatacattacattt

SEQ ID NO: 199019 - DNA, 2734 bp, Homo sapiens
  Payload ID: 19264
  Gene Name: vesicle amine transport 1
  Uniprot ID: Q99536
  ENST ID: ENST00000355653
  CDS Start-End: 97-1278
gctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaggtctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctggg

SEQ ID NO: 199020 - DNA, 1069 bp, Homo sapiens
  Payload ID: 19264
  Gene Name: vesicle amine transport 1
  Uniprot ID: Q99536
  ENST ID: ENST00000420567
  CDS Start-End: 147-926
atctgatgtaagagcctggattctgcggggagggcccttccctctctctccctcctcctccttcctggtgtctgggttggggaggggtcatggccctgatttggatggcctgagggttagcatgagccagggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaggtctctgtggtgatgaccgctct

SEQ ID NO: 199021 - DNA, 478 bp, Homo sapiens
  Payload ID: 19264
  Gene Name: vesicle amine transport 1
  ENST ID: ENST00000592388
  CDS Start-End: 1-91
cgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctg

SEQ ID NO: 199022 - DNA, 1174 bp, Homo sapiens
  Payload ID: 19264
  Gene Name: vesicle amine transport 1
  Uniprot ID: Q99536
  ENST ID: ENST00000587173
  CDS Start-End: 35-1012
atccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaggtctctgtggtgatgaccgctctcccctgcccctccccgctt

SEQ ID NO: 199023 - DNA, 613 bp, Homo sapiens
  Payload ID: 19264
  Gene Name: vesicle amine transport 1
  ENST ID: ENST00000590924
  CDS Start-End: 151-613
cagaagatctgggcggagccctgggaacagaggcctcagagccggggtccagcccgccggtgtggtctgaggggcccctgccggtttgggacaggccgaactgggcttatttgactttctcggatataagggcaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggtgagttag

SEQ ID NO: 199024 - DNA, 570 bp, Homo sapiens
  Payload ID: 19264
  Gene Name: vesicle amine transport 1
  ENST ID: ENST00000589709
  CDS Start-End: 118-570
gagtgaagatgttttctgggctcccagtgctggctcaaacacacttctcccgaggtgaccacaccctgctgtaagcgctcagagaactttgcctgcactttggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctat

SEQ ID NO: 199025 - DNA, 521 bp, Homo sapiens
  Payload ID: 19264
  Gene Name: vesicle amine transport 1
  ENST ID: ENST00000589828
  CDS Start-End: 244-521
ttatatataaagcacttgaaatcgggctcggccctcagtcagcactcagtaaaggtgagttgttattgttgttgatgatgatgttattattattattattaccatgactattgctgcttctcctgctacttcatttggaagaaggtagccttgtacctagggggaaatcagtaaatagcctgtgggtgaatgaatgagtgactgaatgatactcttctgttcttcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacga

SEQ ID NO: 199026 - DNA, 600 bp, Homo sapiens
  Payload ID: 19264
  Gene Name: vesicle amine transport 1
  ENST ID: ENST00000587062
  CDS Start-End: 163-600
agaagatctgggcggagccctgggaacagaggcctcagagccggggtccagcccgccggtgtggtctgaggggcccctgccggtttgggacaggccgaactgggcttatttgactttctcggatataagggcagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagag

SEQ ID NO: 199027 - DNA, 582 bp, Homo sapiens
  Payload ID: 19264
  Gene Name: vesicle amine transport 1
  ENST ID: ENST00000587147
  CDS Start-End: 1-378
tcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtgaatgtgaggactttgcagggagggcttgggtaggactcatgaaggctggggtcccaaggggcagattcctggggaagaggagggctgcctgcatcacactggctcttgttggatgagggttggatagcactgggagccgcatctttccttcctccccaggtggctgatgccatgaaacagatgcaggagaagaagaatgtgggcaaggtcctcctggttccagggccagagaaggag

SEQ ID NO: 199028 - DNA, 3825 bp, Homo sapiens
  Payload ID: 19265
  Gene Name: vesicle amine transport 1-like
  Uniprot ID: Q9HCJ6
  ENST ID: ENST00000302536
  CDS Start-End: 154-1413
gtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctgtggattaaacttcattgacttgatggtgcgacaagggaatattgacaaccctcccaagactcccctggtgccaggatttgagtgttctgggattgttgaagctctgggggacagcgtgaaaggatatgagattggagaccgtgtcatggcatttgtcaattacaatgcctgggcagaggtggtctgcacaccagtggagtttgtctacaagatcccggatgacatgagcttctccgaggctgctgcattccccatgaacttcgtcacagcctatgtgatgctgtttgaagttgccaacctccgggaagggatgtctgtgctcgtgcactcagctggtgggggcgtgggtcaagctgtggctcagctgtgttccactgtccccaacgtgactgtctttggaacagcctctactttcaagcatgaagcaatcaaagactctgtgacccacctctttgacagaaatgcagactacgtgcaagaagttaaaagaatctctgctgaaggtgtggacatcgttttggattgcctctgtggggacaacactggaaaaggtctcagtcttctcaaacccctgggaacctacattttatatggctcatccaacatggtaactggagagaccaagagcttcttcagctttgcaaaatcatggtggcaggtggagaaggtgaaccccatcaagctgtatgaggagaacaaagtcatcgcggggttttcccttttaaatctgctcttcaaacaaggccgggcgggcctcattcggggagtggtggaaaaactcatagggctctacaaccagaagaagatcaagcctgtggtggactccttgtgggctctggaggaggtgaaggaggccatgcagcggattcacgaccgagggaacattggcaagttaattctggatgtagaaaagaccccaactccactgatggccaatgacagcacagagaccagtgaagcaggggaagaggaggaggaccacgagggagacagcgagaacaaggagcggatgccctttatccagtaactgaggacccaggtgggagaatgtgaaggatggtttggaagatgaggacccggctgagaaaactcttctgtgccccagtgaacaaatgctgtagtccagtgcgtgtcgtgtttgtctgcagtcagctgagctaaaaagctgttgatcactgttgttttttgaagtgccaatcccatgccatgcagtattatgtccctctcctatctgtgtattacacattcccctctcccctgtatcaaaaccatccatctgtgggttcttcttgacagttctagaacagccttgcaaattaatacaagtcccaggcccaatgcctaagagaccagacgtgggcaaagacaagtttggatggaaaggtgttatcacagagccctgtccagctcctagaattcctcaggccagtgacacttttttgctgctggccacccatgcctctgatgagaacacttgccaatttggccagcagaaagagagtaggccggatgttttcatgagcccacaaatttagaaactctcctagtagtactttttctctctccatttaagagacaactacggtcaaaagtttgagccattctcttctaccccttcagtgtctgaccctttcactggctcttatctgtaaacacagggaggcaggtatggatttttcacagtagacaatgggtcaacagcatgagtttgaggacctgctgtgaagatttctcctccaaaatacatctcatgggcaggattcttcctgctccatatctgtttcaattttaagaaagcaccacatacaagacacattcagaagtcattcctgagcattgctggtgtttgcacacttgccacctgcattaccaattctgtaaatttcaattcctggtggaaagtgaccactttgaccatggatttcccaaagaagagttcctttgcagaccataggtggaaaagtcaatgagcatctccttccttgccaaagcatgtcccaacatgtaacaaactctagggatacaaaaggtttatattcagcatctgatgtcagatgtacagttcctcccctcccatatataaaccccggtgtagaatctgcagcgccctgctcttcggaaaccaaggaacaagccacctgctcacacaccttgttcaacttttcagctcctaaggaaccccacccccatgcaatttgactgtgcttgagaggtgaatacagttaccttcgagaaacagagggagctcctcaccccgtccttccagtccttttggctaaaatgcttaactatcactcacaaacaaatgtggagataccaggagctcatttgattcataccccaactttgtgttctgaaaaacatcagagggattttacattgcccagtttctccaccaacaagccttagggtggacccaaccctttccgcaagtggtaggaacgaatgcatcttagcaattacctgatttccaaagtccttttgtagcaaatgtcacctcattcgtggtctttttacctatcctaagcttatgatgatgagttatgtatgccaaatacttatctgaagagtttctcctcattgtgaatgtgtatgtaaaatatgaagacaagaaagggtgctttcatctgaggaaccaaggggtgagagtatcccaaaggaggacaccagcatcatcttttcttcgtactccaggacccaccaatattccagttctgggtcatttagagagataatggggcgtttattcccctattacctttgctaagtgctatattattggctgtttctcccgtaaccatgctgaaaagggggtcttagggagaactgtcatccaagtggcattcctagtaagttgggtagaaatgacattttccagagctgaaggagtgaagagcccttggccatactagggctctccttcccccggggagtgggaactcagccacattcagaattcacatcgcctttgttatgtccagaggagaggcataaaaaggcactctcccccaccacccctaccaaatctgggtttggtttggttttatttaactagcaaagttaatccagtaatcgcaaattactccagatggttaaagaaaaccctttcagaatacagaacgagaaaactagagtttgaccaataagaccaatttctgccatgaagaaccgggggacgcaagttaattgtttaacgtactctcattttaagcaccttctttcctgtctcttgattgttttttctgaaggaagtgtaaagaatgtctcagtctgccttaaaggaactgtgaaggcttctctgtaatttaagcttgatagaagtgaactgaaacattgtctaatgtctttgtggctttagagcttttgttatattgtgcctataaagcaaattatgtttacataaaaatataaataaagtattcagcatagcaaaacctca

SEQ ID NO: 199029 - DNA, 4131 bp, Homo sapiens
  Payload ID: 19266
  Gene Name: vesicle transport through interaction with t-SNAREs 1A
  Uniprot ID: Q96AJ9
  ENST ID: ENST00000393077
  CDS Start-End: 117-770
ccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagaatcatccagaaccgcatcctgctcgtcatcctagggatcatcgtggtcatcaccatcctgatggcgatcactttttctgtcagaagacactgatgtatctgctctcccttgataaacagcaacaacagcttgttctgagtaattaagacaaaatggtcacatgaatcattctgttgcgctgacaggccccaggtgaccctctctctccctcaccgccgttgggctgaagtgcaaagagtgtaaaaatattttctattcctgtttgcatgtgggttggtttccttttcgaggtttgtcttcacccagattcgttttttagaggggaaggtgaatgtttatttacctttttgctaatgtcatcaactagccaaaatagccccagtgacactcctagccctctggacgtgtcaagggccgtggtttgggagaggacatgatgagtcagtcacgagagcttctgtttgtcacccgcctcttgttgctgaaaagctcttctgtgatgtctgaggataaaaatgcagcaaaaagcaggggatggagtcagtgaccccgtccagcaagccagccctgttcctacacaggcctcatgaatatagtcatcaacctgcctgagtgctttcattgtaaaggtcggtatttaatgtcggttgtacaggaaattgacttagcactttccctgtttttctattgcataattttttttttaacccaaagatattttttttgctgagcctgcccagtattcactgttcacaactttgattactggctacaagaaatattttcttgccttccccaaatcccatactccccagaatctgctggcaaagtgagccctggtacaggatttaattgtgacctcgtcttccctgacctgtgtaagcatctctgtatcctttcggttttaatatctgcactgccaaaagcagtcctcatacttgcaaaaggtctgacaaggttctctccacatacattccagtatgtaaagagaccatgaatatttcagtaagagcaagaacatgactccatcagtgtgaaatttcaaatgtgattataaatatgggagagtcctataggagggtccaccagagataaacttcacggaaaacgttccctaacctcctttaaaagaatagaggatggcagattgttccaaaaggaatggcttgggtttttaactaacaaatgttagcaagcctttcttgaattcactatgtattcaaacttctaatatgctttgtgatttttttctttcatttctttctgtctgaggtaaccaggaattgcgttcaaaatgagctcatttgtgatcaggcttaaaagttgcccaagctgaggtcgtttccccccagtcacaaagcagaatgtttttctcaagacttcataggcacttactggtccgtactatctttggaatataattagaagctttgaatccttgaaaagcaaacctgttctcttcatcaaaaatgctaaccacctgtgcccgtggatcaatatcacctggatgtagtgcttgatatttttcccaactcagaagaaaaccattatggtttagagaggaaatgcagaatggcagaatccaccagagaaattgcacttatcgaaacaggccaaggcctgcatgtgttcggataaatcatttagtattgtgtaaataaagctgcagcctttacttcggagggatggtgtgggattttggccgagggaagcaggacagagaaggagcaggaagctatgctaattttcctgtcagcttaagggatccgtctcagcaagaatcttgtattctgataacggaatgctgtacgtgctgaccacatctaagaaccattaaaaagcaaggaaacaaacaaacaacccttttctcattccgacacacgaatagtcatcgagtattacaccagcccctctggtggcttccttcaaaactgttgatcttagctaaagtgtataaccagttaccagctgcacttcgcacggccatcccgtccacaatgcagcagactcttcccaaggccacctagcaagcaaggttgatcggatcatctaaactggccgcctcctgaatatttcactgaatcctggcgttcatgttgaagcagacaaaatgagaaaggaggagggcattgctcacctctcaatagcttttttcgttcaagttctatgtctttatcagctcttgcctgtgattttaccccaattcaaccttgggagtgggaagaatatgaacagataacccttggcctaacagctccatcaaacctccttgagagcaactacctaggccaggctagtgagtgctttgtgaggaagctggtcagaaggttccctcaactccttcctggtcctcctggacactgcagaaaagacttaggggatccccagcagaggccaattgctctccttccttccctgccccaccaggaaaggaataacgtccacagacttgaagcagatagtgaagtagatctgtgagaggttctaggtacttagtgtgtagactttgacgaatatttctcaagttgggagcccttgttaaaaatgatgtttaagggagtggttggggggaagatgaaggcatggaggaggaagaagagaaggaagcccttgccatataaaattcatgcagactaaacagtttccctgacagaataaataaagtggatgctaccccactccagaatcaaaagcaatttaattaaagtctcttaagttgtaaagagttttaaatgatccgtgttgaaggcgaatgcctgcaaatgcagtgggtctgacgtcagctgccgggcctgggctgggaggccatttgctattctgtttaaggcaggctggattgtcttattttggaaccagcttggtggggggtttgctttgctactgcttctgagccctgagcttcaaaggctgaaattaatggtgaacaaaattgtgcggctctggccatcccatgcggggcaagcccattgagggttatcattaagtaaagaaataaagagggggaaaaaagcctgcctgttccaaaaacctcatcagataatgacctcagtgattgggttttcattaccaaacagcatccagagattatcaacccatagaagaagggaggggaaaaaaaagaaagaaaggaaaagcaactgtctttctctccctctctttctcctttttttttgcacatcttttctttaaaactgtcagatcatttcagtatttcaaatccgaggaaaacagcctgcctgctgctgtatttgaagttgtaatggtgtcaaaaagtcacgactgactgacagccgtcagtcccagaggggctcattaaatcataaaaacttgacaaggaaataattgcgcattgccagcaacttggcgcctgtttagacgtttttattttctttcattattagtccccaccattacgttcattaacaaattgcattaaacaactgttaagggctaa

SEQ ID NO: 199030 - DNA, 1738 bp, Homo sapiens
  Payload ID: 19266
  Gene Name: vesicle transport through interaction with t-SNAREs 1A
  Uniprot ID: Q96AJ9
  ENST ID: ENST00000432306
  CDS Start-End: 117-728
ccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaaggggttgttctgtgaaaaaacaatgtaacctgtctctggccccaaaggcttgaaccagaaccagccagtggaaattactcaaacacgtattgtgccttcaatgagaagccttctcactgaaagagctgccctggacggaaaatgagtagtgagatgatgctggtggaagtatttatagatgcgcagtgcatgagtacttggcaaggatgctatcaaaggggaaactgacatcaaatgtgctgtggttctgggtgatttatctggtcccttcccatcccagagctttatgattctgtaataatcaagggagaaacccattacatagtggacaattttttttctttttttttctttttctttttttttttgagacagagtcttgccctgtcgcctggctggagtggagtggcacaatcttggctcactgcaacctccacctcccaggtccaagcgattctcttgcctcagcctcccaagtagctgggactacaggcacacaccaccacgcccagctaatttttgtatttctttttttttttttttgtagagatggagtttcaccatgttggccaggatggtctcgatctcttaaccttgtgagccaccgtgcccaaccctaacaattatttttaaaaggaggaatttaaatgagctgtggattattcattttgtcccataagaagataattaaaaaatgacaaaaatgaactgaacaaaaaagttctaacaaaataataaggctgaatttttaaagtctcttccgcatcttctgttccctgggatgccttagacggggtgtgcagtattttaggtacatcgtgagcaaggagcctgcattcccagggggcggcagggacagcatgtaaggtcttagtccagctctgtgatctgaaggcaaagcctctatgtgtgaaacacaggggtacctcaaaaatagaacaagagcactccatccatgtgcggatgactgtcaaggtcactgagacctacagtgatctggaaaattaaagctctctggccgcctttcctctcaggacatacttctggagatcaaaaaaaaaaa

SEQ ID NO: 199031 - DNA, 1103 bp, Homo sapiens
  Payload ID: 19267
  Gene Name: vesicle transport through interaction with t-SNAREs 1B
  ENST ID: ENST00000216456
  CDS Start-End: 122-256
ctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccggggagattagtaatttttaggtattaaagatacactcaaccaaagggacagaatgggaaaggctgaaaggggaatgaataacgttctcatcgttcaagtcattgccggtgccacacccagagaaaaacaagcaccacaccagacagcctctcagcaagccgaaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatag

SEQ ID NO: 199032 - DNA, 5351 bp, Homo sapiens
  Payload ID: 19267
  Gene Name: vesicle transport through interaction with t-SNAREs 1B
  Uniprot ID: Q9UEU0
  ENST ID: ENST00000554659
  CDS Start-End: 343-1041
ccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattctcatctaactgtatcccccttattagaaatcctttcaggctctagtacaagacctaccctacataaaggacccaagatattgtccagtttgcagatttcttcaagagatcagctttagctccaaattcacaactcccaatgaaccaatctcttagagtgcaaattacagccttgcactcttatcttatcttgccttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtatttcctcagcaatatacatgccttctcgataggttagtcccccgacaacaggagttcctgtggctggagccagtgtagggtcaaatgcatcaatatcaaaactcaaatggattggtctttgtctcctaaaaaggaagaggataaaataatacttaaaataatacttaactggttgtccttggacactcatccttcttatggttgcaactccttgattttgttgctattagtcctagtactttgttaataaagctgttaatacatttccaggcttcctattcttggaagttactgagattggcaatattaacttcctacataccacttcatgatactgccatttgttctgcatacctcagacagactaactccaatgtatatttctgccttacactgggtattagaacctcttatactaataactgtcaatagagagatttcttcacttctagatgagattgggctctcatctagagacaatttaattagacaatttaaattagtctaatttaaattggcttgatgtaagttatggttgctcttattctctgaacgtaacagcagctgaagtgaactctaattttaggtctgcagttttaacatcttccatttctaacttcattatagccccagtgtccaaaggctgaagctaacaactaagtttcttaacagcttatgaaatgacatactaccagataacaattctgacattaatcacccagaagtaaagacttggtattgggaaaatgctcttaaaattaccatttgattagtattcatctgccatctttctacactgccaagatttgcttaatataaaactcagatgaaacaatcgtgaggctgggaagaatgggacagttgaaacaataaatgcttgtcatctcagaagataagcattaaagatggagataaagaaaaattcatgagacagaagatctaggcaatgatttagaggaaacctcctcccaaaaaccccagaggaagaatatgacctgtgtttcaaattttgcctttctgaactatttaaaattatgtgtatgtttttgctttgtattttaaaagtaaagctgctgtcctcaagaaacaggctaaaa

SEQ ID NO: 199033 - DNA, 565 bp, Homo sapiens
  Payload ID: 19267
  Gene Name: vesicle transport through interaction with t-SNAREs 1B
  ENST ID: ENST00000554636
  CDS Start-End: 1-385
cacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttcttt

SEQ ID NO: 199034 - DNA, 576 bp, Homo sapiens
  Payload ID: 19267
  Gene Name: vesicle transport through interaction with t-SNAREs 1B
  ENST ID: ENST00000556461
  CDS Start-End: 1-310
ccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagagtaactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagcca

SEQ ID NO: 199035 - DNA, 718 bp, Homo sapiens
  Payload ID: 19267
  Gene Name: vesicle transport through interaction with t-SNAREs 1B
  ENST ID: ENST00000555543
  CDS Start-End: 332-511
cggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttc

SEQ ID NO: 199036 - DNA, 3449 bp, Homo sapiens
  Payload ID: 19268
  Gene Name: vesicle-associated membrane protein 1 (synaptobrevin 1)
  Uniprot ID: P23763
  ENST ID: ENST00000361716
  CDS Start-End: 457-810
accacaaatgcctaacaaactgctgaagcgccctccgaagggacagacctcatctccaccccgccccgtccctccgccagactggagcgcaaactatggtcgcattgatcactgaaggatcctcacagcaaccgctcctttccggagtcggatgagaggagagttgtgactggcaattggcaggggcggggcgggctaggcctgtagcgctgggcgaccgtcctgggcatggattgggccgcggggttgtcaccgttatccgggaggcgtggtcagcactaataaaggcggaggccggcgcggcagctgcagtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcgcctcctgttctgaggaagtggggctatgctgtgtgtcactggcttgggttggagggagaccatggggatggggcacttaacaatggagagacctgaatgtctggtaacttggtgtaattcaccctcttgttttctcctgtctctttctcttttccgtctgggacttcctgattcctgtgtccagtctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaagagggtcctgttcctctcttcctgttgatgaaggagcgtgagggtgttagcagtgtgagatctttggacacccatggaatcctttcctccacaccacccgtgcacttgccaaagacagggatgaggcaagtggttcttcctggggcccggccgatcctcaggatgcagagaagtcatgtagacccaccagccccaccttggggggaggcgtgccagcctgtgtcaggtgtgcttgtgtattgctgtgctgtcatggggccctctccttgagagccgcctctctgttcttcctgtagtatattcccctttgaaccaccctttcctgtctgaattctactttgcctcctttctcttcctcctctttgcatggtttgtgtgtatagacagtggaacctgaggatgggatctgctcagcctatcttcggggcaattgctgagcttcaggatgggctattaatgtgggataagcccaggtgcaaggggaggagggcaggctgggaacagagcggagaatgcccatggccctttattccttcttccctcggtccacgaacaggaagaggctgaggccatgctgggcagggtctggatgcccactttccatgcagcagcatttcattgctcaaaaccatccttcctttcctttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccattaaa

SEQ ID NO: 199037 - DNA, 1113 bp, Homo sapiens
  Payload ID: 19268
  Gene Name: vesicle-associated membrane protein 1 (synaptobrevin 1)
  Uniprot ID: P23763
  ENST ID: ENST00000396308
  CDS Start-End: 147-503
agtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaatctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtcttt

SEQ ID NO: 199038 - DNA, 1068 bp, Homo sapiens
  Payload ID: 19268
  Gene Name: vesicle-associated membrane protein 1 (synaptobrevin 1)
  Uniprot ID: P23763
  ENST ID: ENST00000400911
  CDS Start-End: 123-473
gcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaaggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccattaaa

SEQ ID NO: 199039 - DNA, 747 bp, Homo sapiens
  Payload ID: 19268
  Gene Name: vesicle-associated membrane protein 1 (synaptobrevin 1)
  ENST ID: ENST00000535180
  CDS Start-End: 115-465
gtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagaagaggctgaggccatgctgggcagggtctggatgcccactttccatgcagcagcatttcattgctcaaaaccatccttcctttcctttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctc

SEQ ID NO: 199040 - DNA, 2153 bp, Homo sapiens
  Payload ID: 19269
  Gene Name: vesicle-associated membrane protein 2 (synaptobrevin 2)
  Uniprot ID: P63027
  ENST ID: ENST00000316509
  CDS Start-End: 97-447
atctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagcccccactcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttttagaccccccatattatcccagtgtcccctgcccccctcttcccccaccccatgcccccaattctgtggcgcatccagattgtgaaaatgtacaataaatgtgtaatgagtaacca

SEQ ID NO: 199041 - DNA, 874 bp, Homo sapiens
  Payload ID: 19269
  Gene Name: vesicle-associated membrane protein 2 (synaptobrevin 2)
  ENST ID: ENST00000488857
  CDS Start-End: 482-838
agccgccgccgccatcactgccgctgccaagtcctccacccgctgcccccgccatgtgagtcggccgcccgccaccctcaccgcgcttccctgcgccggccgccgcccttggcaaccggccgtcgggagtgcccggggtctctcctgcgttccccgcgccccggggccaggcccaagccggtgactgcgcgcgggcggccgaggagccccgcgtcccgggctggccggctcgggcgatggccgcgggaaggagcggacccagtgtcctcctgcccctccccgcccctgtcaccgcggccgcctgtcttttcgggtcgacccggatcgcatctgtgaggtcgccctcagttgacaggcggggaaactgaggccgggggggcctcgctcaaggtcacgcagctcatcggcggcagggctggaccgagaccagggcttacatcgggtggccttcctcccgaaaaggaggactggagggacgaggatggacaggtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcct

SEQ ID NO: 199042 - DNA, 1479 bp, Homo sapiens
  Payload ID: 19269
  Gene Name: vesicle-associated membrane protein 2 (synaptobrevin 2)
  ENST ID: ENST00000404970
  CDS Start-End: 214-420
gggaccccaggcttcctctgagacatccaccagcggtgatgggttgggaccaatctcccccactcctctccaccctagcagtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcataggtgagtagggtgagaatggccggggccctttccctggagaggtttccccagtggattctaggttttgaaggtcattaatctagtttttactcttcagccaaaaacacatatagctgctaatggcaattctgattcatctagagccaaaaactttgatgttatttagcctgcattttgcctagttcttggcagtcttgttaacatttggaaataggaaagctggtgtatccattgaggaccctttaggcctaagagcccagtctgagaaccctggaattgaggagtgggagaaaggaaaggaccaggggcttgagacatgaccaggaagccaaccaccccattatttgagagcttgcggtctcagaggctcagaggattagggtctgtggcttcaaggccataccatggagcggaagggacctcagaacctacctgtctagccccttgctttgtagatggaaaaactgagtccaagagagggtgtcagccagctggggagtggggaggattggagcagggccaggcctgacacactgctttcttgttctctctctttctctcccctctccctcttcctcatcttcttcccctctctccacagtttacttcagcacttaaatccccgaggagtctgccctgcctagagaagggcctctcccccaaccctcagccgttcctccacctctcagccatatctttcagcccccactcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctc

SEQ ID NO: 199043 - DNA, 557 bp, Homo sapiens
  Payload ID: 19269
  Gene Name: vesicle-associated membrane protein 2 (synaptobrevin 2)
  ENST ID: ENST00000481878
  CDS Start-End: 70-411
agtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcataggtgagtagggtgagaatggccggggccctttccctggagaggtttccccagtggattctaggttttgaaggtcattaatctagtttttactcttcagccaaaaacacatatagctgctaatggcaattctgattcatctagagccaaaaacttt

SEQ ID NO: 199044 - DNA, 2205 bp, Homo sapiens
  Payload ID: 19270
  Gene Name: vesicle-associated membrane protein 3
  Uniprot ID: Q15836
  ENST ID: ENST00000054666
  CDS Start-End: 116-418
agtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatga

SEQ ID NO: 199045 - DNA, 954 bp, Homo sapiens
  Payload ID: 19270
  Gene Name: vesicle-associated membrane protein 3
  ENST ID: ENST00000470357
  CDS Start-End: 575-793
ggtgaaaccccgtctctactaaaaaatacaaaattagccgggcgtggtggcacatgcctgtaatcccagctgcttgggagactgaggcaagagaattgcttggacccaggaagcggaggttacagtgagccgagatcgcgccattgcactccagcccgggcaacaggagcgaaactccgtctctcaaaagagggggaaaaagaaagagtaccttcctaaaagaggaggcatttcttcaacacacctttccactcacaccacccactccctgcatcccagtgttcctgactctgtttctgtaaattaatctatttttccatattggaaaaagggcattctgtaactgtttgtaactatgaaaacagttccttccacaatgaaaagatcaggaaagtactgagtacattcaagcagatgtgtgccttagaacaagtttcaaaaaaggacagtagagcttacctatcgtgggatcagatacttcagggatacaaagtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgc

SEQ ID NO: 199046 - DNA, 5159 bp, Homo sapiens
  Payload ID: 19271
  Gene Name: vesicle-associated membrane protein 4
  Uniprot ID: O75379
  ENST ID: ENST00000236192
  CDS Start-End: 388-813
gacaaccagtggttgttcctcccctaaagcacagcataaatttggagagatgcatctaaactgcgtgtgggttcgggctcttttaggtgaatagggctcggcggatcgacttcctcgattatctccgtgccctggacccgccccctccgcctggcgccaggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgtaagagaatgtgtagtaatttttttggcattggattatggaaatggaaatttttaaacagtgtgaaaaaacatggtatggcatcataaaactggagataataaagttattgaagagtgtcattggagtatttgaaaatgaccaatatatagctgccagtcatggtccagtctgttttctgttaaactccaataaagagagaccagtcagtcctaatgtgagtaaatgaaatttacaggtaacttacttactccttaattttattttagttaatagcctctaacttccaactatctcatttaccaaaagtacaaaaagtagcaaaaccatctattaatactttgaattttatatctttgcatttcctgttcatccttgaggagatgtatgttgcacaatcaaattttgcatcagccaacagtaatgagtagtagaaagtcaggaacctatgtgtatatatatatatatatatatatatatatatatatatatatatacacacaaacacacacacacacacacacacacacgcacacatatgataatcagtcagtcggtaaccaaatgctagagagtgaccattaacctaagcctgtttttataatgaaaaaatgtgttaactttaaaatatgccaacctccttgtgtcttttaaacaagtcagagtgaaaatacattgtcccctaaggtgtggggagaggaagctttataataaaattagtgattctgcagaaacttgtgcactggatatcttgacaatatgaatataaaactccctaaattaaaaatagggttaatagaaattatcagtatttaaatagggaaaaatgattttatgtttattttatttaggttttatttctttggtcatcttaatgcaaaatgaataaagcatagaatctgggtttggtgtttttttgtctgtttttaaaattctacaggattattactaggaggcaaaaaatgctgtttagaatggaaaaaatttgaagagagaaagcagactgagacactcaagacacctgcaagttatctaagaagatctaaatagaattactaaattttatagtttgcttagagcatttagaaggagataaaggtcttacatactatagtgtatattgtctttggtctctatgctctttgtaaatgtcaattaatataaacagcatctgaacagctaataaatcttttaagttaagatacccagaaaaatgagcatttttagaatttcagtagctaataattcaggaatggaaatattttaactgaatggacagaatcagtcctaacatttgtatgtatgtcctttatttgaattggaactaggctcataagtggttaattttccattagttgatgtagaaatctggtttctccataatatctacaagtgaagatgaagattacttctcaaaaagtatccatatttccagtgttccttttaataaaatatgccacttttaaataaataattacaaaatgtaaaattataaaatttttaaatttaaataataagtaacagtaaaattttttgacaatatatatgtcactgtctttgtaatttaaacatattgctgcctgggatatgggtaacagaattatcactcatggaactttgtagtagtgatggcttggtttgtaattcatcatttcatctttcttggtcttgattaatcctgaaatccttaaaatggctggcatggttatgactttattgtggtaaccttggagatataagccctcttacgatcaaaaacagaagaaaaaaatatattgttcaaactgatgccaggcctacctttattccctcccttaattactttttttctcattcagctcagatcatcctgcacttgaaaaatgaagttttaccaccatcaaaactatcattatttaacaacaagtgaagatcaacagaaaaattcaagtagctttgcaaatactagttgatactcagtgaaatcacgtcactattttgatgcctgaatccatacctttgtgatttatgtttaattacagaagcctattgccttgcagcaattttgttgttataatactgattaattggttactccttcttattataactcagtaatacctgtggtcatttggttcctctatcctgacaaagttcactggaaattgccctcagattttataaactgggggatttcttaattagataaaagttcattactgaagatggaatattatataagatggaggaagggtaattaatagacatgagatatagaaatactttgttagccctgctatagattgcctattgtagtctttctgtgcatttcaatagtctgtattaggaaattataacttcagcacttttgatagcaaaaattggcatctttcaattctgtatagtatgtgactatcctgtaaatgataatatgtgtacagactgagaaggcaggaatataaagtaattgaaatctctcattgccggtatactctaaaacatgcttgatgccttgtcagcatcattgcacacattgactctgtatttacatctgtatatacactatgattagaaaatatgcaagaaattgtttttccatgttaagaacaaatgccattagaagatgtccccttaattgtattgtcagagtattactatgtcaaggatgactgttctgttaacctaattttgtgttttcacatggaaatgtgattggactccatttttctgtgagttgagagtaagagcataagtcagtttgaaagcatttacaagtttgttttagaatgtagtaagggctgaaaggtgctctacttcttaacttgttttttccatgttgtagacaaatgaaatttgtctaaatgcttttgtctaaaaatgcatttgtctaaatgctttagattgatgtagggtttagatcctctttaatactttgagatagtcttattctgattttttttttcttctggaaaccaagtagaattagggatgggaatacaaatgcatttattctggcttctgttttattccaagaagcttcttggaacaaatcagtaggaattgaaaagaaagcatgaccaacccaattacaggggataaatgtaagcttgttaaagtaagcaccacaccatgtttctgtctccccagcacccagcacagtgctgtgaaccttggcagatgctagataaatgtgtgttgaatgaatgtgcctatgaagccacaaagatgccacatgttagtatatcagtgagaggtgactccacagtgctctctggagaagcaatatgagtgactgaagagtggggccttttgcttttgcctggatataggggtgctcttctactgtaattgggtgtggaaaaactctggctttatggtattccattaggttcttttcatttaaagtagtcttaaaatcaaagtatccaatattttaaagccacaaagtagattacataattagcagagattttagtcagtaaaatgttagaaatcaaactataagaaaattcaagtcctttattttgtgtcttgggtatatgtcattattttaaattccacactcccttatttaatcactttggtaagtgcctttgatgttttgaaatgtatagtgggagatgagcaaatgtaaatgtcatgtgccctgttccctagcttctcaattcctcataaccatttttaccagtgttgcaaagtttagacctttgtgttaatatcagaagtgtatttgtagcccctccatagtgaacaatgaaataaactatttcatagaaaacaaaaa

SEQ ID NO: 199047 - DNA, 1193 bp, Homo sapiens
  Payload ID: 19271
  Gene Name: vesicle-associated membrane protein 4
  Uniprot ID: O75379
  ENST ID: ENST00000367740
  CDS Start-End: 215-637
gatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctgggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaa

SEQ ID NO: 199048 - DNA, 1738 bp, Homo sapiens
  Payload ID: 19271
  Gene Name: vesicle-associated membrane protein 4
  Uniprot ID: O75379
  ENST ID: ENST00000474047
  CDS Start-End: 201-626
gcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagagctcagatcatcctgcacttgaaaaatgaagttttaccaccatcaaaactatcattatttaacaacaagtgaagatcaacagaaaaattcaagtagctttgcaaatactagttgatactcagtgaaatcacgtcactattttgatgcctgaatccatacctttgtgatttatgtttaattacagaagcctattgccttgcagcaattttgttgttataatactgattaattggttactccttcttattataactcagtaatacctgtggtcatttggttcctctatcctgacaaagttcactggaaattgccctcagattttataaactgggggatttcttaattagataaaagttcattactgaagatggaatattatataagatggaggaagggtaattaatagacatgagatatagaaatactttgttagccctgctatagattgcctattgtagtctttctgtgcatttcaatagtctgtattaggaaattataacttcagcacttttgatagcaaaaattggcatctttcaattctgtatagtatgtgactatcctgtaaatgataatatgtgtacagactgagaaggcaggaatataaagtaattgaaatctctcattgccggtatactctaaaacatgcttgatgccttgtcagcatcattgcacacattgactctgtatttacatctgtatatacactatgattagaaaatatgcaagaaattgtttttccatgttaagaacaaatgccattagaagatgtccccttaattgtattgtcagagtattactatgtcaaggatgactgttctgttaacctaattttgtgttttcacatggaaatgtgattggactccatttttctgtgagttgagagtaagagcataagtcagtttgaaagcatttacaagtttgttttagaatgtagtaagggctgaaaggtgctctacttcttaacttgttttttccatgttgtagacaaatgaaa

SEQ ID NO: 199049 - DNA, 689 bp, Homo sapiens
  Payload ID: 19272
  Gene Name: vesicle-associated membrane protein 5
  Uniprot ID: O95183
  ENST ID: ENST00000306384
  CDS Start-End: 84-434
gctcttcctccggggccgctggcactgcggccgctccgcaggcagagaagccgggagcgggcgaggcggcggcggcagcagcgatggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgattaaaagctggtatctgtgtgtgaa

SEQ ID NO: 199050 - DNA, 2496 bp, Homo sapiens
  Payload ID: 19273
  Gene Name: vesicle-associated membrane protein 7
  Uniprot ID: P51809
  ENST ID: ENST00000262640
  CDS Start-End: 84-866
ggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagtctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatga

SEQ ID NO: 199051 - DNA, 2646 bp, Homo sapiens
  Payload ID: 19273
  Gene Name: vesicle-associated membrane protein 7
  Uniprot ID: P51809
  ENST ID: ENST00000286448
  CDS Start-End: 166-828
tcccactcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatga

SEQ ID NO: 199052 - DNA, 658 bp, Homo sapiens
  Payload ID: 19273
  Gene Name: vesicle-associated membrane protein 7
  Uniprot ID: P51809
  ENST ID: ENST00000460621
  CDS Start-End: 81-620
agttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaa

SEQ ID NO: 199053 - DNA, 696 bp, Homo sapiens
  Payload ID: 19273
  Gene Name: vesicle-associated membrane protein 7
  ENST ID: ENST00000488344
  CDS Start-End: 99-278
cctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaa

SEQ ID NO: 199054 - DNA, 774 bp, Homo sapiens
  Payload ID: 19274
  Gene Name: vesicle-associated membrane protein 8
  Uniprot ID: Q9BV40
  ENST ID: ENST00000263864
  CDS Start-End: 157-459
ggaaacctgagttaggtgtggctggagcgactcgagatgcgaggtgggcgggggcaggctgaaagttggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 199055 - DNA, 805 bp, Homo sapiens
  Payload ID: 19274
  Gene Name: vesicle-associated membrane protein 8
  ENST ID: ENST00000409760
  CDS Start-End: 55-354
gaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacaccaggggctgaggccagctgtttcagggaggaagtaactccaaagttgagcaaagtctggagcctcaagttctgtgttcagcggggaggctggctctggctttctgagtcctgtgtgaactcttggctcttggtctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 199056 - DNA, 664 bp, Homo sapiens
  Payload ID: 19274
  Gene Name: vesicle-associated membrane protein 8
  ENST ID: ENST00000432071
  CDS Start-End: 159-383
gtaaatactacccacgaccggcggcgccggattccttgcttggcggcagggggcggaacaaggagccttggagcggggcaaaggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtg

SEQ ID NO: 199057 - DNA, 2962 bp, Homo sapiens
  Payload ID: 19275
  Gene Name: vesicular, overexpressed in cancer, prosurvival protein 1
  Uniprot ID: Q96AW1
  ENST ID: ENST00000285279
  CDS Start-End: 202-720
gggagcgcgcggcggccgggggcggagcgcagccagggctgcgcggcgcgccccggctcccgcccgctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggca

SEQ ID NO: 199058 - DNA, 1671 bp, Homo sapiens
  Payload ID: 19275
  Gene Name: vesicular, overexpressed in cancer, prosurvival protein 1
  ENST ID: ENST00000428097
  CDS Start-End: 436-753
tttgttctcagcctgtgcggagtgtaacgagcccactctaattgggctcaagctgaaagcagctgggatctcattgcctgtgtgtcaagttctgcttttgatgaatgcagaagcagtgtgaggcacagcagggggcccctcccttttgaaaaagatggagtccttgggctgatcttctttggggccgtcccaccatcctgaagcaaaccctggacttctggcccgggacagactgttggccaaagccgttgccgtgataagtaacataaggatccttactttccagagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctc

SEQ ID NO: 199059 - DNA, 1317 bp, Homo sapiens
  Payload ID: 19275
  Gene Name: vesicular, overexpressed in cancer, prosurvival protein 1
  Uniprot ID: Q96AW1
  ENST ID: ENST00000418904
  CDS Start-End: 198-665
atagtgctccgtcacctttctgggttgagcatggctgagtgactcagcccatgggaggtttcctaggagaacaggctccacttgctgcctctctgcgtgaactccgtgtgccggcaacctggcgaccagactcctgccttcggaggggctggggctccaggacctgagtgccccccattgttggaaggcggtgtcatatgtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttg

SEQ ID NO: 199060 - DNA, 649 bp, Homo sapiens
  Payload ID: 19275
  Gene Name: vesicular, overexpressed in cancer, prosurvival protein 1
  ENST ID: ENST00000453256
  CDS Start-End: 231-548
agcagctcccgccccttggcttgcattctctcctcgagttgagcttctgcttgggcctcgcttcctcagctcctttgccagcacggcctgaaacaggggccaccgtgtgagcttcctggagcccagagatgagaagataaagatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaa

SEQ ID NO: 199061 - DNA, 632 bp, Homo sapiens
  Payload ID: 19275
  Gene Name: vesicular, overexpressed in cancer, prosurvival protein 1
  ENST ID: ENST00000427700
  CDS Start-End: 42-554
tcgggctgctcttggagatgcacattgcttctgatgcatagatgaggatcagaagtcttcatccagtacagcagactgaaccgactacttgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttcca

SEQ ID NO: 199062 - DNA, 574 bp, Homo sapiens
  Payload ID: 19275
  Gene Name: vesicular, overexpressed in cancer, prosurvival protein 1
  ENST ID: ENST00000455023
  CDS Start-End: 287-574
attcacatgctttgtttccttccctttcagcctcacatgtggccctttaacagctcattagttttgttttaaggacaggcagggagagagcaatggggagaagctgaattcagtttggttgaatctttgggatgaagggtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgccc

SEQ ID NO: 199063 - DNA, 485 bp, Homo sapiens
  Payload ID: 19275
  Gene Name: vesicular, overexpressed in cancer, prosurvival protein 1
  ENST ID: ENST00000452832
  CDS Start-End: 421-485
gctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagagacagtttccttagcaaagctgctggacacacttgtgtttgatttctgctcctggagatgcagtaattgacagtgttgagagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgcc

SEQ ID NO: 199064 - DNA, 610 bp, Homo sapiens
  Payload ID: 19275
  Gene Name: vesicular, overexpressed in cancer, prosurvival protein 1
  ENST ID: ENST00000454227
  CDS Start-End: 135-464
agagacttgggagcagccctgctgtgcggctgcaatctgaaaggaaatgatgcctcgttgctaggcctaggaagaggtgcacagaagccaaaaagcattgctggtatttcgaaggactctatccaacctattatatgttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttca

SEQ ID NO: 199065 - DNA, 591 bp, Homo sapiens
  Payload ID: 19275
  Gene Name: vesicular, overexpressed in cancer, prosurvival protein 1
  ENST ID: ENST00000417399
  CDS Start-End: 434-591
agagctccctgagcagtggggatgctggcctgcctcacttgctggaggtttgtgagagcctccaggtggcatctggcccctgctccgatgcctgtgtgcactcacccaccctgccctgccctgccctgccctgccctgtggggctgggccctgcctccgggatgttaggagctggacttacctggaaagcccaggagaggctcccattgtctttccttgttccttctttctcttcctgcacgtgagagggcaacgagtgaaccgtgactcgcagcatcttgcagactgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacac

SEQ ID NO: 199066 - DNA, 2866 bp, Homo sapiens
  Payload ID: 19275
  Gene Name: vesicular, overexpressed in cancer, prosurvival protein 1
  ENST ID: ENST00000428648
  CDS Start-End: 308-625
gcgccgggcagtttggggttaggaaaggatgggtgccgagccggggtgaggggagcgggcggaggggactgtggggaagtgtcgcgggagtgccgggagttgtggaggtgagcagcgggaggaggcgttcccgcgtgtgaaaatgaagtgcagcctttagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggc

SEQ ID NO: 199067 - DNA, 2900 bp, Homo sapiens
  Payload ID: 19275
  Gene Name: vesicular, overexpressed in cancer, prosurvival protein 1
  Uniprot ID: Q96AW1
  ENST ID: ENST00000433959
  CDS Start-End: 168-659
agatgttctcaccactcaacagaggaggatactgcagggtctgcgggcgccagagctttatttatgtgtgctccgtattggagggctgcgtgtgacccagcagtgacaggaccgtgggcgactggctggcgaggaggtgcgctgcctgcatccttgcgcctaacagaatgcgaaggacgggctcacatgctcagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggc

SEQ ID NO: 199068 - DNA, 539 bp, Homo sapiens
  Payload ID: 19275
  Gene Name: vesicular, overexpressed in cancer, prosurvival protein 1
  ENST ID: ENST00000414113
  CDS Start-End: 284-539
agatgttctcaccactcaacagaggaggatactgcagggtctgcgggcgccagagctttatttatgtgtgctccgtattggagggctgcgtgtgacccagcagtgacaggaccgtgggcgactggctggcgaggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgc

SEQ ID NO: 199069 - DNA, 1400 bp, Homo sapiens
  Payload ID: 19275
  Gene Name: vesicular, overexpressed in cancer, prosurvival protein 1
  Uniprot ID: Q96AW1
  ENST ID: ENST00000625836
  CDS Start-End: 4-513
acaatgctcagcgaaactcttgggtatctgtcttctgtgctcttgcagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctca

SEQ ID NO: 199070 - DNA, 1215 bp, Homo sapiens
  Payload ID: 19276
  Gene Name: vestigial-like family member 1
  Uniprot ID: Q99990
  ENST ID: ENST00000370634
  CDS Start-End: 171-947
ctagaggggcggaaagtaacaaggaggtgggggtacaaatcctcagctcctgcttccgcaagcactaacctgctctgaagtgagccaggcagctctggccatcttttcccagccacagaatcaggtgatggtccagaattaagagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacgatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgcta

SEQ ID NO: 199071 - DNA, 451 bp, Homo sapiens
  Payload ID: 19276
  Gene Name: vestigial-like family member 1
  ENST ID: ENST00000456412
  CDS Start-End: 1-183
accccctcgagtcagagtgaaggtgtgatgctgaaaaacgataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgcta

SEQ ID NO: 199072 - DNA, 486 bp, Homo sapiens
  Payload ID: 19276
  Gene Name: vestigial-like family member 1
  ENST ID: ENST00000440515
  CDS Start-End: 1-486
catcagcagcgtagtggatgaacacttctccagagctctgagcaatatcaagagcccccaggaattgaccccctcgagtcagagtgaaggtgtgatgctgaaaaacgatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacataagaaactatatgtatctcgtggatctgccagtaccagccttccaaatgaaactctttcagagttagagacacctgggaaatactcacttacaccacc

SEQ ID NO: 199073 - DNA, 1709 bp, Homo sapiens
  Payload ID: 19277
  Gene Name: vestigial-like family member 2
  Uniprot ID: Q8N8G2
  ENST ID: ENST00000352536
  CDS Start-End: 207-638
gcttctgccctggagcgcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctgcggagagtcatgagctgtctggatgttatgtaccaagtctatggtcctccgcagccctacttcgcagccgcctacaccccctaccaccagaaactagcctattattccaaaatgcaggaagcgcaggagtgcaatgccagccccagcagcagtggcagcggcagctcctcattttccagccaaaccccagccagtataaaagaggaagaaggcagcccagagaaagagcgcccaccagaggcagagtacatcaactcccgctgcgtcctcttcacttatttccagggggacatcagctccgtggtggatgaacatttcagcagggccctgagccaacccagcagctactctcctagctgtaccagcagcaaagcaccaaggagctctgggccctggcgagctcgtcgttattccctctgtggtgcatccctcctgagctgatctgctgacccagggtttccccttccccttcccttctgaccagccttggaggctcagcatctgtgcctctcactccgtggatgaggacatgggggaaggcagagacttcagacttctcagtgtgttgggaaaaccaaaaaccacaactacagaaattcatctaaaaataagtcctgctgctgaaagagcaaatccaaagactgagttatgtttaatgacttttggccgaatcactggaaatatctgtggtgagattgctgagtcaggtgatgtgatatcataagctttcttggaacgggggaaagaaaatgaaactttttggtgtgaatattttttatgctgatgtgaattattttgttaggtagtgtgattatagcactactactgtcagattttaaattgtatgtgtacttgcatctaagactgtggtagagaagtaaagagaagtcaattccttcttcctcacctctcagcctccagatcccttcctgcccatcccttccctacaatgcccactccagacgcaaagatacacttttttcctttggactgtgaacatggaagcctcagcctgaatgtgagtggcaagtggcttatctggagccacctgcccaagtcttactaaaatgcagctgttgttagacaactgttgaaaactccagaaatacatcacccaaggtggcagttctcagtatttggcagaacaattgcaattgcactgggtatattatatatatatatgtatgcatatatatcatattttttacaaggaacattttatgatgaaagaagaaacccttctctgccttctctcccacgaattctgtccctgtatcctctggatgtaaaaagcaaggagagaccccaactgtctccatggagaagaactaggaatcaccacaaggggaagaaatgtacatgaagtctccattacctcgaatttttttctcagtctcactggttgtgatttggtcactttagtgttgggacaggggaaagggtctgtgcgtgggcaaagctgaaggtgatgaggaagaagagacgaacattaaagatgtctatttactatga

SEQ ID NO: 199074 - DNA, 2212 bp, Homo sapiens
  Payload ID: 19277
  Gene Name: vestigial-like family member 2
  Uniprot ID: Q8N8G2
  ENST ID: ENST00000326274
  CDS Start-End: 191-1144
gcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctgcggagagtcatgagctgtctggatgttatgtaccaagtctatggtcctccgcagccctacttcgcagccgcctacaccccctaccaccagaaactagcctattattccaaaatgcaggaagcgcaggagtgcaatgccagccccagcagcagtggcagcggcagctcctcattttccagccaaaccccagccagtataaaagaggaagaaggcagcccagagaaagagcgcccaccagaggcagagtacatcaactcccgctgcgtcctcttcacttatttccagggggacatcagctccgtggtggatgaacatttcagcagggccctgagccaacccagcagctactctcctagctgtaccagcagcaaagcaccaaggagctctgggccctggcgagactgctccttcccgatgagccagcgcagcttccccgcctccttctggaatagcgcgtaccaggcgccagtgcccccgccgctgggcagccctctggccaccgcgcactcggagctgcccttcgccgccgccgacccctactcgcccgccgcgctgcatggccacctgcaccagggcgccacggagccctggcaccacgcgcacccgcaccacgcgcacccgcatcacccctacgccctgggcggcgccctcggcgcccaggccgccccctacccgcgccccgccgccgtgcacgaagtctacgcgccgcacttcgacccgcgctatgggccgctgctgatgccagccgcctcggggcgcccggcccgcctcgcaaccgccccggcgcccgcgcccggcagtcctccctgcgagctctccggcaaaggcgagccggcgggcgccgcgtgggccgggcccgggggacccttcgcgagcccctcgggggacgtggcccagggtctgggcctcagcgtggactcagctcgtcgttattccctctgtggtgcatccctcctgagctgatctgctgacccagggtttccccttccccttcccttctgaccagccttggaggctcagcatctgtgcctctcactccgtggatgaggacatgggggaaggcagagacttcagacttctcagtgtgttgggaaaaccaaaaaccacaactacagaaattcatctaaaaataagtcctgctgctgaaagagcaaatccaaagactgagttatgtttaatgacttttggccgaatcactggaaatatctgtggtgagattgctgagtcaggtgatgtgatatcataagctttcttggaacgggggaaagaaaatgaaactttttggtgtgaatattttttatgctgatgtgaattattttgttaggtagtgtgattatagcactactactgtcagattttaaattgtatgtgtacttgcatctaagactgtggtagagaagtaaagagaagtcaattccttcttcctcacctctcagcctccagatcccttcctgcccatcccttccctacaatgcccactccagacgcaaagatacacttttttcctttggactgtgaacatggaagcctcagcctgaatgtgagtggcaagtggcttatctggagccacctgcccaagtcttactaaaatgcagctgttgttagacaactgttgaaaactccagaaatacatcacccaaggtggcagttctcagtatttggcagaacaattgcaattgcactgggtatattatatatatatatgtatgcatatatatcatattttttacaaggaacattttatgatgaaagaagaaacccttctctgccttctctcccacgaattctgtccctgtatcctctggatgtaaaaagcaaggagagaccccaactgtctccatggagaagaactaggaatcaccacaaggggaagaaatgtacatgaagtctccattacctcgaatttttttctcagtctcactggttgtgatttggtcactttagtgttgggacaggggaaagggtctgtgcgtgggcaaagctgaaggtgatgaggaagaagagacgaacattaaagatgtctatttacta

SEQ ID NO: 199075 - DNA, 2475 bp, Homo sapiens
  Payload ID: 19278
  Gene Name: vestigial-like family member 3
  Uniprot ID: A8MV65
  ENST ID: ENST00000383698
  CDS Start-End: 377-1339
ggctgcccgacccgggcctgggctgtggctgtgactggcgctgccgtgggcgccgcagccctcgcgggagccggacgcggtaatgccccagcggcgcagcgggcggctgcgtccctgagccgctatataagcgcggcagggaacatccggaggggctgaagatgaaggtgcccgcgcatgggcccccgctgattgccagtccctcccgaccccgcgccccgcgcggagcccgaggccgccgaggacccgccttcgccgcagtagcagctggagcagcgacagaggcggcagctgcggcggcggcggcgcccgcgcccctcgcgccagcgcgtagagcggcggcggcagctcgggggccgccactgccccggctgccatgagttgtgcggaggtgatgtatcacccccagccttatggagcgtcccagtatctgcccaaccccatggcagcgacaacctgccccacagcctactatcagccggcgccccaacctggccagcagaagaagttagcggtattcagcaagatgcaggactctctggaagtcacccttcccagcaaacaagaggaggaggatgaggaggaggaggaggaggagaaagaccagcctgccgagatggagtaccttaactctcgctgtgtccttttcacttatttccagggagacattgggtcagtagtggatgaacacttctcaagagctttgggccaagccatcaccctccatccagaatctgccatttcaaaaagcaagatggggctaacccccctatggcgagacagctcagctctctcaagccagcggaatagtttcccaacttccttttggaccagctcttaccagcccccacctgcaccttgtttggggggagttcatcctgacttccaggtcactggaccccctggcaccttttctgcagctgatcccagtccttggccgggacacaacctgcatcagactggcccagcccctccccctgctgtgtctgagtcctggccttatcctttgacatctcaggtgagcccatcctacagccatatgcatgacgtgtacatgcggcaccaccaccctcatgcccacatgcaccaccgccaccgccaccatcatcaccatcaccaccctcctgctggctctgccctggatccatcctatgggcctctgctgatgccttcagtgcatgcggccaggattcctgctccccagtgtgacatcacaaagacagaaccaactacagtcacctctgctacctcagcatgggctggagcctttcatggaacagtagacatagtgcccagcgtgggattcgatacaggctggagtgcaatggcgagatcttgactcactgcaacctctgcctcccgagttcaaccaattgtcctgcctcagccacctgagtagctggaattacaggcatctgccaccacgcccggctaattttttgtatttttagtagatagtcactattttgaatagtgaaggctggcttccctattttgaatagtgaaggctggcttccctattttgaatagtgaaggctggcttccctattttggccaggctggtctcaaactcctgacctcgtgatccacctgcctcggactcccaaggtgctgggattacaggtgtgagccactgtgtccagccctcatgtacaaatttttaagtaaatgtgtgtttaattctcttggaaatatatctaggagtagaactgtggggttaagagaacctcactttttattttatgtatttctatattttttgaatttttttcaaagagcatatatatgcaatttttaaaatatttaaatttaaatttttgttttttaaatttttttttagtatttaaattgttaagattcattacaacatattatagtagagtttgaggtttggtaggcaaaactgccataggaatgaagtaaggtggtccattttttccgaagggctgagtggtggtgaggacagtgaggtgcctctggcacaaaatttaaaaggatccatactgtgagggctgtgcaagtgtatgccaccccatattttgcacccagggctccttattcctctaacctctgtcttggtgttgctttgctgtcatgcgagctcactcttactttttgctccctctgttgaacaggtattacatacaggtaccttgaaatgatcagtatggtatgatcataagtcatttgtatttgccctccacgtgaaaaatgctcatctttaccaagaggctgttatcacaaatctcacattaggctttttccctttcctttatcagtctttaaactgagtttcatgggttccataggaaaaatactcagaatgtgataataagggcttaattgaaaaaagaaaagatctattatcaaatgaatttatttacattgcctaccatatacctcttagagatcacagttccctatagcatataaaatgttttatatattcttcagtaaaaaagcattttaaattgt

SEQ ID NO: 199076 - DNA, 10400 bp, Homo sapiens
  Payload ID: 19278
  Gene Name: vestigial-like family member 3
  Uniprot ID: A8MV65
  ENST ID: ENST00000398399
  CDS Start-End: 365-1345
cgggcctgggctgtggctgtgactggcgctgccgtgggcgccgcagccctcgcgggagccggacgcggtaatgccccagcggcgcagcgggcggctgcgtccctgagccgctatataagcgcggcagggaacatccggaggggctgaagatgaaggtgcccgcgcatgggcccccgctgattgccagtccctcccgaccccgcgccccgcgcggagcccgaggccgccgaggacccgccttcgccgcagtagcagctggagcagcgacagaggcggcagctgcggcggcggcggcgcccgcgcccctcgcgccagcgcgtagagcggcggcggcagctcgggggccgccactgccccggctgccatgagttgtgcggaggtgatgtatcacccccagccttatggagcgtcccagtatctgcccaaccccatggcagcgacaacctgccccacagcctactatcagccggcgccccaacctggccagcagaagaagttagcggtattcagcaagatgcaggactctctggaagtcacccttcccagcaaacaagaggaggaggatgaggaggaggaggaggaggagaaagaccagcctgccgagatggagtaccttaactctcgctgtgtccttttcacttatttccagggagacattgggtcagtagtggatgaacacttctcaagagctttgggccaagccatcaccctccatccagaatctgccatttcaaaaagcaagatggggctaacccccctatggcgagacagctcagctctctcaagccagcggaatagtttcccaacttccttttggaccagctcttaccagcccccacctgcaccttgtttggggggagttcatcctgacttccaggtcactggaccccctggcaccttttctgcagctgatcccagtccttggccgggacacaacctgcatcagactggcccagcccctccccctgctgtgtctgagtcctggccttatcctttgacatctcaggtgagcccatcctacagccatatgcatgacgtgtacatgcggcaccaccaccctcatgcccacatgcaccaccgccaccgccaccatcatcaccatcaccaccctcctgctggctctgccctggatccatcctatgggcctctgctgatgccttcagtgcatgcggccaggattcctgctccccagtgtgacatcacaaagacagaaccaactacagtcacctctgctacctcagcatgggctggagcctttcatggaacagtagacatagtgcccagcgtgggattcgatacaggtctacagcatcaagacaagagtaaggaatcaccgtggtactgaaacacacaatcttagtgagttaagttgcagcataaatccaagggcccactgggaaaagatactgtcgggtttttccattcagcaataggacacgaaaggcatagaaggagaagacaaagtgtcacgcagttgactggttttcggcctttcttgagaaagcaaagtgggtcccagacattgaagaaaagcatttttatttgtttatttcctcatctgagcctttgccaactgtgcaactctctccttttgttatcttgcttttatcaatatatagctaagtttttgtttcattttgatttttttttttagccaaccaccttgtcaggaaaggatgaaccacacattaaaatgttcattctttcaggaatacaagtttgtagctctatgtgcatctatttttgtagaaatacaaaaagtttggtttagcattgatgggctatttttgagggatgtattttttttaaaattgtaaaaattgttgagttctgtttaaagaacttgctctcagagaagcactggcaaaaatgtttaaaatgcttatctctaagatgtctattatatgctctgtctgtgctttctaggttacctcaaatgttttgtttttttccttcttacaaaagtagctataccgtagtcaaaccaatgcagtattgtttttacattgaatctcagtaaagatttaattccatgctagctcaattagttttgaattatatgtatagcttgaaaagtttttttttaatgactgtgctaaagaaatgatattttattgctttgatttctcccaaagaataacttggaggttgactaataagaaagttggcataaactttcaatcaaatgaagagtttgcctagaggagactaattctctttctagcccatccaaatttgataaatggaaccagaggttatatacaactacaaggaaaaaaatgcatttaaccatgccacctatgagtgccagtgacttattttacttgtttttaattattcattcatggcaatttaaaaagtcatattttaagtgggatttgtttttcctgaagggcatttgaaggaacaatatctgggaaggtactagagaaattacaaagcccgagctctttcttataatgccacctatccctgtaagctaaacaaacaaacaaacaaacaaacaaacagttctatatataatagtttcaacacagaacttaacaagtctctttttttgtttgtttaaatctggctttacttgatttaattcctttttagaaagaaatttagggcaaaataaagtgtatattaggatttaaatttatgccacaatttaaaaataaaaccagaggttatatacaatttaaattgggctaaaaattaaaaatttgaggatttaacttgatatagctctcaggatctaaataaagtttaaattatcattaagacactgctaggagaagattaagattatgaaagtaacagttattgatactgctggacttcaaaggcaaagttcatttcttccattaactgcttccagagatgtcatgtaaaaaagttagtgtattagagaagttttttagctttataaagaggttttttcaaatttctcccatttttctctccacccacataaaatagtatgttcagtgaaatgccactttctatctttaattgttcgtatcatatatgcgaactttttagacatgaacatgacatgttcagctaggcagagttctcatagataattttcaaatattttccttggctgtaatttatgtattcatttatatcctatccgtcttttgagcttcagatctatatactcttttgtactctcatcactccgcactttgctgtttcttacctagactctcttttacacaatatgcacatttttaccattgtggggtccaaatttaagataccttccactcactaataatatgaacttatatttcctgggagtagccaggttaaattttctatactttggtccataatttgatttgatatgattgtttcatttataatttgcccaaatacatggagcacaaaatttagtgaatttataaatctggatttgccttgtgtccttctgagttttcaaaggcaagtattcaacagtccctgtgtgatgactgacagggttatttgcctcatccacatccaccttcggaatacattaacttcctttgtaatttatttgaaagtagtgttaaactcattcagatcattcagttggattttcccaatgaagaggaaaaggaaagtagttattcctagctccatttcttattttccaccaaatttaattgaagggcattaattagatgtcttcaccctgaatttagactttgctctgtgttctcccggtaactgtcagacaaaaagtttattggctctgaggaactgagaaatgttgggaacctggtttctgctgtacacaggaaagatttgtaagtgagctctctctttgaaaacaggacccaggctgggcacagcagctcatgcctgtaatcctagtattataggaggcagaggctcgggaggattgcttgagcccaggagttcaagatcagcctaggcaacatagggagaccctatccctacaaaaaatttctgaaaaattacctgggcattgtggggcacacctgttgtcccagctactctggaggctgagtccggaggaacgtttgagcctgggagtttgagtttgcagcttgcagtgagctgtgattgcaccactgtactccagcttgggcaacagagcaagatcctgtctcaaaaggaaaaagaaaacaggacctaggtgtttggggtacactgccacccagggagtggatcaaaaatatacatagaaagagaatgagcatgtctctataattgtcttctaggaccatattgctgttagaagtcctaaaagaggatgggttgtaatttagcataatattctgaattcattccaagtttaaaatcctgtcattctctggctcttcttttttcacatcaaaatgatgctgttggacttagaggcttccgaactgttttattgagggctactatctgcctccacaattttattaaaaccactccacctttagacaaaggtgacttttgtctgattttacaaatcagattttattcaagctttctaaatatctgtgaagtagaccctagaaaattgtctcgtttattttaaatagaatctatgcttccaccaataaaccatcgggagctaagaaacaacataatgttgacaaatcaggaacctaacagattattttgtctctcattattaatttgaaagagcctctaaacttttgagaaatcaatgtgtcttcttaagaaagttaagcaccctctcttaactttcccctctatttgctctcctttttctttcttcttaagagtatttatattattttgttaagcaaaaatggctaagattgctctaaaatttgcaaaatgaggagtggattgcaaataattgagggatttatttctttaactttataagactttaaaaaaaaaacccaaattctaagcactgacatgaaagttgcctttgagaagcttgttattcattatacaaaaagtatttgcccattcctattctaagatttgcagaatatgtcaccctatctagcttttgagtttgctatctggtttaatgttgtatttataatttaaagtggaaatcagaaactgtttcaagaacctgtattctattccttactgagtgtcccttctttaaatagtgtttgctgaattaagccgatgggggcagtggcgttaagtggtggaaaaaggaaagtatatatgttagagttttgaatgagggataaatagaaagcagaatgaattaatggaaaagaactcggctgttaggccattctctaaattctagtttagccaaaagtttatgtgtggtttggggcttcatttatttatctcatgagtaaaatggaataatacctaacaggcaggctctggaagttggaaatcacatacacacacacacacacacagacacacacacacacgatcaatcatgtagctcatattagatgttcaataaataacagctactacagatgcctatcagttgagtaagtagttcattaaattgagctcccaaaggtctcttctcttcacatccatatccgtttctgcagcaatcaaatagatacatgattgtttttctgtaagaaattactgcaaagagaatctttttctcctactaactgttccttctacctggtataggagataaatgtacgtttcttaattagctgactttttagtatgtcatttctgaaggaaaaataaattaaccttaaagtggcatgtaggtccaattcagttttcctacatgttccaaaattttatttaaattactgtgtccaaaattatgaggacagtgtcattcattcaccatagtttatatttttagttatatatcaaacttccttggcacctaggataagaacatttcttttgaagttatccaatttttttttatttttacttgacttgaaggaaagttggaaaatatggtggaaaaaatcttccgcattaaaagggggaaaaacacaaccatttacgatctcagtcagcagatttactctactcaaggaaaaaaagaaacaatcttattggaagcagatgttgacactgtgtcagttattgaagacggaaggagttcacttgagccattgcagttacaaaggggtattgatggcagtttggattcctgattgatcacctttgcagccaagggaaagacagcagaaactgtatgggatcagaaatgaaatcagcctgccagtttaatggagaggctcctagaaactcattttttttctttcctgtaagataaaagacatctttcagaataagaaaggcttgtttgagagagaaattacagtttattctctgaaaatatttaaaggccaaagtgccctttaaatctattattaaagcattgaaactgttattaaaatcattatagaaaaattaggtaaaaattttagcctaactttcaacatccattcaaaaacgaatgttgaaaacaaacatataacctataaaaaagtgaatggctctggcaagtgggggcatgggtggagtccataaggaaacctcagtctcaataacttcaaaatgttacttttcatggtaacttggtcatggagattggtcacagcacagacatttagaattttttagcaggttttttttttcttttgaatcttgtagtgctctctgggaattgcaccatgtacacttttacaacctacagaaatcgtcattattgttaaagtatctcaacttttctatttcttttattgtctattgtgcttttttgtttaaaaatacttttatagttttaaagtattggtcaaagtagtattctcttgaagttctagtcaatttaatttgatccaataagtttttctgaatctcctttttaagttccaagaaattctattataaataagtgtacttttaccaattccattgtataagcaaacagacaccttttagaaaaggataagtaatcatcaatttgtttttttaaaaaaaaaaacaatttctagactactaaatttggcataagaataattcttttaaaatgcaacatactttaattagtttttttggtatatgcataagatgtgaactttcctattgatatcactttatattaatagagatgtacatttctttctatgccgtggctagagcaaaagttaataatgattatttacacaattgatttaatttcttaggatatgtataatattggatattatatctgatttaaaaatactattccatacattttttttttcaggagataaaacatagggaaaggttttcatgtgaattctttgtatcactttgaagtacatatatttaaagggaagatggatacaatttgtttttattatataaatctaggtaaggtgaaatgcttttgtcaacaaaaatacagtgtagtgaattttatatttgtcacttgattaggtaaactgaaaactaacaatagaaatattattttactgcattgaaataccatgaactttcagacttgttagttctacaagaagttgtgctaccttaattttgtgtttccagaaataaaaattaaccttagttatgctgtcatttttaactaataaaaaaagtataattcataaaacttttggctttataagataattataaaattatatatttttttctgtttttgtggggttgggaaaacattttcttatttctattcactcttcaaatgcaggtctcataatatgtgtcaatgatataagatgatggaagactttgtaataaaaacatatgtcattatcttcaatttgttcaataaataatttaatgtgaattgaatgtttgtattttaacatagcatttggatttggtctgcatttcttgagaatttaaagctctttttgtttcctccttattcaattaagcatcttataaatattttggaaattacaacatcttaggtgttattaattaagaagttaatttctagggccaagaagtctatatgttacagcaaggaatagattataaaatacatgtttataatggaaaagaaaatgaaatggggtatattaattacataacagcaagagtcttgagaattttataatacaatgcttctaaggatattggttgaccaaggtgtattttattgtttttacatttgttgacagggactctgccataagtagtatgaaaaaacaaacaaaaacttttctacgattcattaacattgaaaagagaattccaagaccttgtattctgaagaaagctagagtttctctaagtgggccttcaattttcttattacacgtatctttaatgtgaaagtactaaagtctgaaaatcagcatttaaataatagactttccagcattacagatgaaataatttggcgcaggctttttaactgtctaccatatttagaatgtggtgtcaaaatgagatttttagaactgctgtaaaatattactacattactacaacgataacggcctaaaacaacacaaatttattatcttacagctctgtcagtcagacattcagcaaagatcttagtcttggtgggctacagaatgtaggaggcatttcctggatgcttccaagagagaatcttgctgttccctgcttctagagtcctttgcttagtttccttccatcttcaaatccagcaacctggtcaagaccttctcacatgacatcactgacttcctcttcttcctctcccttacatatttaaggactcatgtgattacaatagctgcatctgtgtaatccagaataatctcttcatctcaaggtttttgttctgttttgtttttttgttttgttttgttttgttttgttttgatggagtcttgctctgtcgtcaggctggagtgcagtggcgcgatctcggctcactccaacctccacctcccgggttcaaaggattcccctgcctcagcctctcgagtagctgggactacagatgcgtgctaccacacaaggctaatattttgtattttagtagagacgggatttcaccatgttggccaggatggtctccgtctcctgacctcgtgatctgcctgccttggcctcccaaagtgttgggattacaggcataagccattgcgccatgctcaaggttcttaattacatctttaaaggccctttttccatgtacagtaacatattcaatggttctggggattaggacttggagccattattctacctacaacaattagtattggacttccatcattttctatcactcttgtaatcgagaaggactatttcactgggagtagcaagtcataatgtttgcgttggcatttgtgtgggggtttatcttcattcattaaataattgcatgtaaagaaaattcctgtcactatttcaaatgtttcatgtagttattatagtgcttcagaatccaaagggttatgtgttacttatgtaagatgagcagtctagggggtggagaacaggtcatctagtgcagattcttcctagctgaagtgtgttttctctggggacaaccaagtaggatttaattgttttgcttccttttttgggaacttagacccatcttgcgatgtcctaagtctccaagcatcttatttgacctgcttatacacatttgactaaatagctaaatatgaccacattgacgtggtaaagctttaacacttttgtccagattgaatcactccatctgctatcagttaagcagtggaaaactgttatggaaaagcaaacatgttttgatagatttaatgtgtaaagaaggtatccatactctggaatgctgctgatcaataaatgagctgcaagactttgttcgaaacaacactcaagcacaactgttttactttccataccaagtttggctgtgactgaatgaagaacatcagcattgatctttgctttgcacttgtacaagagactatttgcagagagccaaatatagcaacagaggatttaatatcttgccaaaaaatacaaaatctgttcccctttaagcatgacactctatcctttcttgtggatcttgctaaaaggaaaatatagctttaaactcccctattccttctgttgaaagcttaagaatctttttcaaatgagctatgtatggttttgtggtattttatgtttccaaaagaaaatggctacatgaaaaatctgtccagtgttatcatttttcttacaaaaaatacttctagttatggttgtattaattaatttgattgtgataatgattacacaatgtttacctatatcaaatcatcatatcgtataccttaaatatatataacttttatgtgtcaattataactcagtaagtctgggaaaatatcgttaagtcaaagattagagtcaacagaaataaagaaaaatcatactttgataacttcaggactaatcaaggatcaatgggtgacatgatatcatgctatgtgccattttgtgttaaacaaattacaccaacaataaaaaaaattggcttcaatcaa

SEQ ID NO: 199077 - DNA, 624 bp, Homo sapiens
  Payload ID: 19278
  Gene Name: vestigial-like family member 3
  ENST ID: ENST00000494229
  CDS Start-End: 1-624
agcgtcccagtatctgcccaaccccatggcagcgacaacctgccccacagcctactatcagccggcgccccaacctggccagcagggagacattgggtcagtagtggatgaacacttctcaagagctttgggccaagccatcaccctccatccagaatctgccatttcaaaaagcaagatggggctaacccccctatggcgagacagctcagctctctcaagccagcggaatagtttcccaacttccttttggaccagctcttaccagcccccacctgcaccttgtttggggggagttcatcctgacttccaggtcactggaccccctggcaccttttctgcagctgatcccagtccttggccgggacacaacctgcatcagactggcccagcccctccccctgctgtgtctgagtcctggccttatcctttgacatctcaggtgagcccatcctacagccatatgcatgacgtgtacatgcggcaccaccaccctcatgcccacatgcaccaccgccaccgccaccatcatcaccatcaccaccctcctgctggctctgccctggatccatcctatgggcctctgctgatgccttcagtgcatgcggccaggattcctgctcc

SEQ ID NO: 199078 - DNA, 3725 bp, Homo sapiens
  Payload ID: 19279
  Gene Name: vestigial-like family member 4
  ENST ID: ENST00000273038
  CDS Start-End: 367-1239
acatttcagagcagtccgggttgtggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 199079 - DNA, 437 bp, Homo sapiens
  Payload ID: 19279
  Gene Name: vestigial-like family member 4
  ENST ID: ENST00000424709
  CDS Start-End: 193-437
gcactttcctagtttactcagaggcctctgaggctacctgagagccagagtctagggaatggaggaccaagaatagaaggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctgga

SEQ ID NO: 199080 - DNA, 581 bp, Homo sapiens
  Payload ID: 19279
  Gene Name: vestigial-like family member 4
  ENST ID: ENST00000417206
  CDS Start-End: 74-581
agggattcctcgcgctcccgcgctcccgtccgccggcccggtccgcgcgtgcgtgtgcgtgctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcaggtgggcctctgtctgggagggtggcgtgggg

SEQ ID NO: 199081 - DNA, 544 bp, Homo sapiens
  Payload ID: 19279
  Gene Name: vestigial-like family member 4
  ENST ID: ENST00000437722
  CDS Start-End: 363-544
atagtatgagaggtgctttgtgttgccacccaagggctgggggattgcaggcgatccttgcgcttgggcagacagcacgtcacggcttttatctgccggctcgcattgcaatgggcgtcctataaaaaaagaaaaaagtgagccagaatggggctagccacaagttgaacaatttgaaggagattgacttcacggtgtcttctccccagctgctcgaccgtgagacaaagaagtattatttgaaagaaagcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacct

SEQ ID NO: 199082 - DNA, 766 bp, Homo sapiens
  Payload ID: 19279
  Gene Name: vestigial-like family member 4
  ENST ID: ENST00000458499
  CDS Start-End: 197-766
ggggtttcaccatgttggccaggctggtctcgaactcctgaccttagatgatccaactgcctcggcctcccaaagtgctgggattacagatgtaatgaaatctccagctctgccagatcttttgtgtcatgagaaaaaaccaaaacaacttagttcctgcccatccagggcttatctttgaagtaataagaggagaatgaaagacttgaagaaaagagtggcacttggatacatttccacccacacaggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagc

SEQ ID NO: 199083 - DNA, 792 bp, Homo sapiens
  Payload ID: 19279
  Gene Name: vestigial-like family member 4
  ENST ID: ENST00000418000
  CDS Start-End: 192-792
gcgcgtgcgtgtgcgtgtgcgtgtttggcgggggcccgtgcgggggctcgggcgcgagcccgcctgtgcgtctgcgcgccctcggggtgcgccccgcgtgcccaggtcccgtccccgcccctgggtcccccgcagggccaggccggccccaggcgggcgcgcccagagccgccgggcggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcg

SEQ ID NO: 199084 - DNA, 466 bp, Homo sapiens
  Payload ID: 19279
  Gene Name: vestigial-like family member 4
  ENST ID: ENST00000419541
  CDS Start-End: 85-466
ggcaggaacacctggcagtttgaatgtgattcctccgatgctcacccccctggcctccacatctagacaaggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttg

SEQ ID NO: 199085 - DNA, 1025 bp, Homo sapiens
  Payload ID: 19279
  Gene Name: vestigial-like family member 4
  Uniprot ID: Q14135
  ENST ID: ENST00000424529
  CDS Start-End: 319-939
agtgcccgcctaggatggggatgaggcccggggcggggccgggtgccgtgcagcctcagcggctctgataggcctggcacggagccactcagagtcctttgggtgttcgcggggatgccgtgggctctctcgggcacagtcctgaccaggagcggaggcgacttccatctcccgggcaggatgcgtgcggttttctgccgtccccgggagcacatgacgcctgggaagcagtggccgggaggtgattcatccgggcgagcggggcctggaaaacaatgtctgtcttgaagctccgggaaccaggaaaatgagctggaaatgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgg

SEQ ID NO: 199086 - DNA, 1377 bp, Homo sapiens
  Payload ID: 19279
  Gene Name: vestigial-like family member 4
  ENST ID: ENST00000430365
  CDS Start-End: 407-1297
atgccaagcatagccctcatgtcagcgctgccggcttgcagcgggctgtgagaggggccggcgccgctttgtcctaggaaacgggctgcgcgtttctctttttcactcttttccatttccaggaaggacttgtaaggacttctgaaacgctgttttcatactcgatcggggatacagtacatacaccgtctaccagtaagcccttgaagggtttcgtgtgagctcgatttttttgtgcctgatttttttttttttaacttttgcatactttgttttgatagtctgaggctgggcctctgcctttgtgaagttgaagagccaggagctactcagcaacaattgatttttgaaacttaactcttttggggcaaaagcaaagagctggttttctttgctagcccaataaatgctatttatgaagatggacctgttgaactatcagtacttggacaagatgaacaacaatatcggcattctgtgctacgaaggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaa

SEQ ID NO: 199087 - DNA, 1554 bp, Homo sapiens
  Payload ID: 19279
  Gene Name: vestigial-like family member 4
  ENST ID: ENST00000413604
  CDS Start-End: 372-1067
aattttaaccccaccacacatacaacagttaccactcttgtctaacatacaagtgttgggttaaggccatctagggaggggccccaaagatgcataaaggcacataactgaacggacctgtccctgaccttatgtgcggattcttttcctttgctgtaagccttgtgtgaggctgcacagtcttaggatgaggcgttgtctgattgcagaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactatt

SEQ ID NO: 199088 - DNA, 894 bp, Homo sapiens
  Payload ID: 19279
  Gene Name: vestigial-like family member 4
  ENST ID: ENST00000417466
  CDS Start-End: 454-894
gcgctcccgtccgccggcccggtccgcgcgtgcgtgtgcgtgtgcgtgtttggcgggggcccgtgcgggggctcgggcgcgagcccgcctgtgcgtctgcgcgccctcggggtgcgccccgcgtgcccaggtcccgtccccgcccctgggtcccccgcagggccaggccggccccaggcgggcgcgcccagagccgccgggcggctccaaccaggaatggagacgccattggatgttttgtccagggcagcatctctggtgcatgctgatgacgaaaaacggtcttgctctgttgcccagactggagtatagtggcacaatcttggctcactgcaagctccgccccctggggctcaagtgatcctcccacctcagcctctcgagtagctgggaccacagcgtcacctgggaacttgttagaaatgcagaatcgtagtcctcgctgcggaactgatgactgagaatacgcattttgacaaaatccctgagtcctgtgcactcaaaagttggagacatccaggtctgcaccatggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgcc

SEQ ID NO: 199089 - DNA, 726 bp, Homo sapiens
  Payload ID: 19279
  Gene Name: vestigial-like family member 4
  ENST ID: ENST00000445411
  CDS Start-End: 56-726
gggttgtggacgccaggagtttgccaaacacagcaaacactggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcc

SEQ ID NO: 199090 - DNA, 1428 bp, Homo sapiens
  Payload ID: 19279
  Gene Name: vestigial-like family member 4
  ENST ID: ENST00000426568
  CDS Start-End: 461-1348
ggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaaccgtcacctgggaacttgttagaaatgcagaatcgtagtcctcgctgcggaactgatgactgagaatacgcattttgacaaaatccctgagtcctgtgcactcaaaagttggagacatccaggtctgcaccatggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaa

SEQ ID NO: 199091 - DNA, 938 bp, Homo sapiens
  Payload ID: 19279
  Gene Name: vestigial-like family member 4
  Uniprot ID: Q14135
  ENST ID: ENST00000451674
  CDS Start-End: 93-725
atccagttttgtgcctgagactgcttgccaagtttgtgaggcccaaggctttcttgtgggaggacgctgggctgtcttcatgctctttggcaatgattaaagtgaggaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactac

SEQ ID NO: 199092 - DNA, 728 bp, Homo sapiens
  Payload ID: 19279
  Gene Name: vestigial-like family member 4
  ENST ID: ENST00000623028
  CDS Start-End: 552-728
ggcctttctaaaacgcccagcccgtccctggaggccacaggttattgcctgtgttctcttctcttttgatagccagccaagaagagggaacgcagggtgactcaccaggtgcccacctggactggatttaagtcagaagagaaggaagatgtgagtattcattaaacgtctctgcgaagcctgtaaccccacaccggctcttcgaagggctaagatccagtgagacaccgtgctgttccttgatatgatcagatgaggcaacagatgggaaaacagtttgaaaactgcaaagcattttttttttccagcacgaatgacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagc

SEQ ID NO: 199093 - DNA, 4919 bp, Homo sapiens
  Payload ID: 19280
  Gene Name: v-ets avian erythroblastosis virus E26 oncogene homolog
  Uniprot ID: P11308
  ENST ID: ENST00000288319
  CDS Start-End: 104-1543
aatctcatccgctctaaacaacctcatcaaaactactttctggtcagagagaagcaataattattattaacatttattaacgatcaataaacttgatcgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 199094 - DNA, 4651 bp, Homo sapiens
  Payload ID: 19280
  Gene Name: v-ets avian erythroblastosis virus E26 oncogene homolog
  Uniprot ID: P11308
  ENST ID: ENST00000398897
  CDS Start-End: 184-1275
aaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 199095 - DNA, 4806 bp, Homo sapiens
  Payload ID: 19280
  Gene Name: v-ets avian erythroblastosis virus E26 oncogene homolog
  ENST ID: ENST00000398905
  CDS Start-End: 63-1430
ggtcagagagaagcaataattattattaacatttattaacgatcaataaacttgatcgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 199096 - DNA, 4809 bp, Homo sapiens
  Payload ID: 19280
  Gene Name: v-ets avian erythroblastosis virus E26 oncogene homolog
  ENST ID: ENST00000398907
  CDS Start-End: 63-1433
ggtcagagagaagcaataattattattaacatttattaacgatcaataaacttgatcgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 199097 - DNA, 4954 bp, Homo sapiens
  Payload ID: 19280
  Gene Name: v-ets avian erythroblastosis virus E26 oncogene homolog
  ENST ID: ENST00000398910
  CDS Start-End: 187-1578
cccccgagggacatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 199098 - DNA, 4914 bp, Homo sapiens
  Payload ID: 19280
  Gene Name: v-ets avian erythroblastosis virus E26 oncogene homolog
  Uniprot ID: P11308
  ENST ID: ENST00000398911
  CDS Start-End: 150-1538
gttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 199099 - DNA, 1868 bp, Homo sapiens
  Payload ID: 19280
  Gene Name: v-ets avian erythroblastosis virus E26 oncogene homolog
  Uniprot ID: P11308
  ENST ID: ENST00000398919
  CDS Start-End: 296-1756
gctgagcccgtcggcgccgagggagttagtgcgacccggctcggcgcgcacggccaaggcacgcgcgctggcacacgcgggcgcggacacgcgcggacacacacgtgcgggacacgccctcccccgacggcggcgctaacctctcggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactg

SEQ ID NO: 199100 - DNA, 5034 bp, Homo sapiens
  Payload ID: 19280
  Gene Name: v-ets avian erythroblastosis virus E26 oncogene homolog
  Uniprot ID: P11308
  ENST ID: ENST00000442448
  CDS Start-End: 273-1661
gttttcacttggtcggaatggggagagtgtgcaagagatcgctgcgggacaggttcctagagatcgctccgggacggtcgtgacggcccccgagggacatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacacc

SEQ ID NO: 199101 - DNA, 1595 bp, Homo sapiens
  Payload ID: 19280
  Gene Name: v-ets avian erythroblastosis virus E26 oncogene homolog
  ENST ID: ENST00000453032
  CDS Start-End: 155-1318
tccgctctaaacaacctcatcaaaactactttctggtcagagagaagcaataattattattaacatttattaacgatcaataaacttgatcgcattatggccagcactattaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaa

SEQ ID NO: 199102 - DNA, 5023 bp, Homo sapiens
  Payload ID: 19280
  Gene Name: v-ets avian erythroblastosis virus E26 oncogene homolog
  Uniprot ID: P11308
  ENST ID: ENST00000417133
  CDS Start-End: 187-1647
cccccgagggacatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 199103 - DNA, 1052 bp, Homo sapiens
  Payload ID: 19280
  Gene Name: v-ets avian erythroblastosis virus E26 oncogene homolog
  ENST ID: ENST00000429727
  CDS Start-End: 390-1052
gttttcacttggtcggaatggggagagtgtgcaagagatcgctgcgggacaggttcctagagatcgctccgggacggtcgtgacggcccccgagggacatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccaggaatatatagatga

SEQ ID NO: 199104 - DNA, 2231 bp, Homo sapiens
  Payload ID: 19281
  Gene Name: v-ets avian erythroblastosis virus E26 oncogene homolog 1
  Uniprot ID: P14921
  ENST ID: ENST00000319397
  CDS Start-End: 311-1636
gagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagta

SEQ ID NO: 199105 - DNA, 5139 bp, Homo sapiens
  Payload ID: 19281
  Gene Name: v-ets avian erythroblastosis virus E26 oncogene homolog 1
  Uniprot ID: P14921
  ENST ID: ENST00000392668
  CDS Start-End: 86-1543
agttggaaagagaccacagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaggacctagcaacacttatgaagatcctcgaatgaactgtggtttccagtccaattatcaccagcaaagaccttgctaccccttttgggatgagatggcaactcaggaagttcctactggtcttgaacactgtgtctcagatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgtgtgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataa

SEQ ID NO: 199106 - DNA, 3389 bp, Homo sapiens
  Payload ID: 19281
  Gene Name: v-ets avian erythroblastosis virus E26 oncogene homolog 1
  Uniprot ID: P14921
  ENST ID: ENST00000526145
  CDS Start-End: 208-1272
ttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaata

SEQ ID NO: 199107 - DNA, 2134 bp, Homo sapiens
  Payload ID: 19281
  Gene Name: v-ets avian erythroblastosis virus E26 oncogene homolog 1
  Uniprot ID: P14921
  ENST ID: ENST00000531611
  CDS Start-End: 271-1089
ggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatcccttta

SEQ ID NO: 199108 - DNA, 4594 bp, Homo sapiens
  Payload ID: 19281
  Gene Name: v-ets avian erythroblastosis virus E26 oncogene homolog 1
  Uniprot ID: P14921
  ENST ID: ENST00000535549
  CDS Start-End: 317-994
gagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccgggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgtgtgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgct

SEQ ID NO: 199109 - DNA, 545 bp, Homo sapiens
  Payload ID: 19281
  Gene Name: v-ets avian erythroblastosis virus E26 oncogene homolog 1
  ENST ID: ENST00000608978
  CDS Start-End: 407-545
aactagagctgcttgtgttacttcaggccatggcctttctgggggtcaacagatagcttcattaattagatagatcagattcaacttactggccagtgcccctgatattaagttctggctttgtcagtggggtttgttgtattccctcaaccctatcaccatggctcagtgaccctatttggaataccagcaggactagaagggtagtggtgtaaaacctttaaatgatatgaggcactctgcctttcagtgctttttagataaaggttcatagatcactgaagttaactgcagtcttcactctttctggattgacaggaatagcaccctcaaatttcagagccatcagacaccatggtatcatgctatcggagttgactgttgaaagttgcttaatatccctgatatggaatgtgcagatgtcccactattaactccaagcagcaaagaaatgatgtctcaagcattaaaagctactttcagtggtttcactaaagaacagcaacgactggggatcccaaaagacccccggcagtggacagaaa

SEQ ID NO: 199110 - DNA, 3936 bp, Homo sapiens
  Payload ID: 19282
  Gene Name: v-ets avian erythroblastosis virus E26 oncogene homolog 2
  Uniprot ID: P15036
  ENST ID: ENST00000360214
  CDS Start-End: 461-1870
agaatgatcattagtcctaagcccattcagaggttcaagaatggggtcggctcaatttcagggccttattacccaagcccggctgcccttcggtgccaccagcaccactgctccgtcgctgcggaattccaaaggcaggtttggcgttagggccttggccccagagaggacgccgagcgctccacggaaagtctccgcccggctcccagggcgcacactcgcgcgcacgtggggccgaggccctgctcccggggcctcagggccagccggcgagggacccagccgagtgacagcaggaggcggagggaagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatataaa

SEQ ID NO: 199111 - DNA, 3766 bp, Homo sapiens
  Payload ID: 19282
  Gene Name: v-ets avian erythroblastosis virus E26 oncogene homolog 2
  Uniprot ID: P15036
  ENST ID: ENST00000360938
  CDS Start-End: 291-1700
cgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatataaa

SEQ ID NO: 199112 - DNA, 1033 bp, Homo sapiens
  Payload ID: 19282
  Gene Name: v-ets avian erythroblastosis virus E26 oncogene homolog 2
  ENST ID: ENST00000432278
  CDS Start-End: 529-1033
cgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcagggaaacgcaggcctggtagggggtcctgcccagtggatgtcccggcgaacatgatttcgcgaacgggagtgggggcacaggagagcgtgtccgaggtggcctggcgccccggctttgagggtgacttcctggagcggcgccgggcccggaggatctggggcgcccaagacacctgaaggctgcggcaccgcgggaacctgcggggcgcggggtgccatggtcacctgctcgccgcgtccagggcccgggctggggacccctcggtcgtgcgaggagagcgtggggaacctgtcggaaatgagatctggttgcgctgggctgcctttattttctcgttcctacagcatttgaatgaagagatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaag

SEQ ID NO: 199113 - DNA, 972 bp, Homo sapiens
  Payload ID: 19282
  Gene Name: v-ets avian erythroblastosis virus E26 oncogene homolog 2
  ENST ID: ENST00000456966
  CDS Start-End: 162-972
gcccactgccccactgtacccacccaagcactcacctaagctggccatggaaatgtgaatgaaaagcctgacccaggccctcttgccctgctaacccagcaaggaggctctgaccagccagccagcaagtgactttttctgtgacatctaagtggaattcaatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctg

SEQ ID NO: 199114 - DNA, 3435 bp, Homo sapiens
  Payload ID: 19283
  Gene Name: vezatin, adherens junctions transmembrane protein
  ENST ID: ENST00000261219
  CDS Start-End: 1-1383
agcttgctcgtttcccacttggtggattgttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatggggtaaagtccgcatggaattagagggggaaagtctgcactggaacctgctgtggccattttttttctgttgttgctgcttctctagtggagttactgcagcttagggatggttcctggaagtggacacattttacaaaaacgttttttaaatacacgccagctcttcgagaagcacttttttccttccgtcatgcttcatactatattgtattgtactaacccctcatgctgggatgagcgactgcctagcaagcaacccactgcctactaacatcaagaggggctaaataaaactgcattttccttgcaaggacaacttctaccgtatgaatatatattatatttatgtattatattttgtacaatagttgatcttgaatgcagacttcatttgtatttttcgtggtactacaaaatgtgtagaagttatggcttttctttcattagggtcttgttaggtggttggcaagtaagttaaattgtatgttgcatttttttccatgctgttttaacttgtaaatatatatgtatacatatggaagatattattattatctagattactttaagccttttatctgatgtattatcagtgaaaaccatgctgcttattccctaatacaatggttctcaaactttagtgtgtatcagaatcaagatgagggcttgtaaaatatagctggtccctactcccagagtttccatttcaggaggtctgggatcaggcccaagaatttgcatttttaacaaattcctaggtgataactgataatgttggttcagggaacacactttcagaaccactgctttaatattttaaataagataatatgtgaggtgtcataaaaaccttcatcaaatccctatctcatttcatttcttaggcattttctctcttataaagtttcctggatttataaattttcattgattttactagaaagttttatttagcttttatttatttattgttctttttaagaaaaaaactgagagtttgaattaaaagtttaaatcattgctaggtccttagttattttttttcttttttctttttttttatttgaagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgat

SEQ ID NO: 199115 - DNA, 2484 bp, Homo sapiens
  Payload ID: 19283
  Gene Name: vezatin, adherens junctions transmembrane protein
  ENST ID: ENST00000397792
  CDS Start-End: 316-2484
ttttgtactgtggttcttctggagaaacaagtgggaatcatcaaagaaagaaatgtatggataaaaaagaatatggacaagaggcagtaaatttttcatttaggtcaactggagaaattagaaccatgctatctaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacacttttgcttgacagggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaa

SEQ ID NO: 199116 - DNA, 4562 bp, Homo sapiens
  Payload ID: 19283
  Gene Name: vezatin, adherens junctions transmembrane protein
  Uniprot ID: Q9HBM0
  ENST ID: ENST00000436874
  CDS Start-End: 106-2445
gtagttttctggacccacgggacgggcaggagctggagctccgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaattgatgtgtgctggggtttggaactaaaagtagtttcaacagtgcgtgggttatgacatttcttatgtttctttgttcatgtgtgtatttagtagttaattttaagatgtcctagtgatctttaaaagaaaaatattgtaccattttttagaattacactttcacctttctttttgcaattgaaagtgatgatgtcaaagtgggatttctgtactccaaggccccacccccaatttagcaagcagaaaaacgttccttgtatcactttaccttggataattgggtgccattaacacaaacaggtcacaatcctgctgttttctagccctgtccaccataatgagattcaggaaacatcctgtcagcctcctggaaagcatccttgtctccttagtatttcatttacaaactacctcttaacagagactgcttttcaaattggccaatcttacctgttttgtgttgtgattgcattttcaaagagtaattattttcagcatatacagttttgaaacctgtagctcctatgcaataacatagttctatagacattatttgggggaaatgtagtaataactcaatctatgttgctgtcctagaaaggaaattgcatgatgaatctagattgtctttagagtaaagaaacacattcaaattcctgtaacttatcactttcagtgagtaaatttacttataccaaaggggattttttttctttcaggaatctaaggaaatttactttttaacctgagaaaaaaacttggttctgctttatataaacagtagagattattgtactataagtgattttgcctttttgccaaaatcctggaactcatctataattaacctcttcggagcaataccttaggttgggccttgctttactacttagaaatagctaaatttcaattttaaaaatctttgtgtgttataactgttaaattattcaataatacttagggtttactttcttatttaaatcacttatttagtttaccgacttcatttttctttggatttagaagaagcaattatggaaaaacttggtaatctctctcaacctataaccttacacaggaagaattagagtttaataatttttaattcttttattgtatgttacttttattacaccagtttgggggaaaatcttcataaaattgtatcagttttattcagtgttctctaaggtgataccttttaattttgaaagactaaataattttaatcgagaatttccagtctttcagtctgatctatttaattcactacttgttacataatccagtgaaaactctacttgttgaaattatgacataaagatcttgcagctttatttgagtatttgttcttttgtgtagtttccatcttttaaaatatttaaaatattttcaagataaagtattatcttctctgcaaaaattcctggagtaattttctctcataatatttgaagtcagtggttctcagttgtattagtggggtaactacatcaaaataaataaagtcttatttttaaaatgcaaattttagaccatactcccagtgattcttagttggtctttttggaatgagccataggtaatgtttatgtccaataaaatctaggaacctc

SEQ ID NO: 199117 - DNA, 588 bp, Homo sapiens
  Payload ID: 19283
  Gene Name: vezatin, adherens junctions transmembrane protein
  ENST ID: ENST00000548245
  CDS Start-End: 40-339
tttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggtggagccatctcattcttcagtgatactaggactgtggtaaggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctg

SEQ ID NO: 199118 - DNA, 526 bp, Homo sapiens
  Payload ID: 19283
  Gene Name: vezatin, adherens junctions transmembrane protein
  Uniprot ID: Q9HBM0
  ENST ID: ENST00000547484
  CDS Start-End: 44-283
ttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggtggagccatctcattcttcagtgatactaggactgtggtaagtgtcaagcctgatgcctggcttatagaagatattccttgatagatgaatagaaagaagagaaggagaaataaatgagctcgtatatgtgaaggcattttgtaaactata

SEQ ID NO: 199119 - DNA, 1024 bp, Homo sapiens
  Payload ID: 19283
  Gene Name: vezatin, adherens junctions transmembrane protein
  Uniprot ID: Q9HBM0
  ENST ID: ENST00000548455
  CDS Start-End: 41-280
atttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttggttttatcgtaactatattgtagagacaccaagaataggatgggacatggagggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacacttttgcttgacagggtcagtgctgcttgcccatttaataaagctggacagcatccaagtcagcatctcatcggtcttcggaaagctgtctaccgaactctaagagccaacttccaagcagcaaggctagctaccctatatatgctgaaaa

SEQ ID NO: 199120 - DNA, 1068 bp, Homo sapiens
  Payload ID: 19283
  Gene Name: vezatin, adherens junctions transmembrane protein
  Uniprot ID: Q9HBM0
  ENST ID: ENST00000546557
  CDS Start-End: 88-327
gggacgggcaggagctggagctccgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaaggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggt

SEQ ID NO: 199121 - DNA, 562 bp, Homo sapiens
  Payload ID: 19283
  Gene Name: vezatin, adherens junctions transmembrane protein
  ENST ID: ENST00000546445
  CDS Start-End: 267-562
atccgcgatttttttgggtcagtatccagagtgcttcaggtcactgttcaccgtcaaggcgtggccctcggaatgaaggcagcagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaaggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatt

SEQ ID NO: 199122 - DNA, 999 bp, Homo sapiens
  Payload ID: 19283
  Gene Name: vezatin, adherens junctions transmembrane protein
  ENST ID: ENST00000548371
  CDS Start-End: 10-207
cggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaaggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacacttttgcttgacagggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacgggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggtacctg

SEQ ID NO: 199123 - DNA, 482 bp, Homo sapiens
  Payload ID: 19283
  Gene Name: vezatin, adherens junctions transmembrane protein
  ENST ID: ENST00000552821
  CDS Start-End: 26-482
gaggcgggtggcatggcggagaaggatgacaccggagtttgacgaagaggtggtttttgaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttccca

SEQ ID NO: 199124 - DNA, 2712 bp, Homo sapiens
  Payload ID: 19283
  Gene Name: vezatin, adherens junctions transmembrane protein
  Uniprot ID: Q9HBM0
  ENST ID: ENST00000552660
  CDS Start-End: 40-279
tttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacacttttgcttgacagggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaact

SEQ ID NO: 199125 - DNA, 1224 bp, Homo sapiens
  Payload ID: 19283
  Gene Name: vezatin, adherens junctions transmembrane protein
  ENST ID: ENST00000547611
  CDS Start-End: 99-296
tctggacccacgggacgggcaggagctggagctccgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaaggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacacttttgcttgacagggtcagtgctgcttgcccatttaataaagctggacagcatccaagtcagcatctcatcggtcttcggaaagctgtctaccgaactctaagagccaacttccaagcagcaaggctagctaccctatatatgctgaaaaacccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaag

SEQ ID NO: 199126 - DNA, 595 bp, Homo sapiens
  Payload ID: 19283
  Gene Name: vezatin, adherens junctions transmembrane protein
  ENST ID: ENST00000548822
  CDS Start-End: 40-336
tttcccatcgtgctgaggcgggtggcatggcggagaaggatgacaccggagtttgacgaagaggtggtttttgaggttcggccagtgggaaggacctgcagatcagaggatggaggaaagagcgccagagagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccct

SEQ ID NO: 199127 - DNA, 542 bp, Homo sapiens
  Payload ID: 19283
  Gene Name: vezatin, adherens junctions transmembrane protein
  Uniprot ID: Q9HBM0
  ENST ID: ENST00000549624
  CDS Start-End: 40-279
tttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttg

SEQ ID NO: 199128 - DNA, 2362 bp, Homo sapiens
  Payload ID: 19283
  Gene Name: vezatin, adherens junctions transmembrane protein
  ENST ID: ENST00000551994
  CDS Start-End: 34-213
atcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaagtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacacttttgcttgacagggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaa

SEQ ID NO: 199129 - DNA, 564 bp, Homo sapiens
  Payload ID: 19283
  Gene Name: vezatin, adherens junctions transmembrane protein
  ENST ID: ENST00000551039
  CDS Start-End: 34-138
atcgtgctgaggcgggtggcatggcggagaaggatgacaccggagtttgacgaagaggtggtttttgaggcagcagagcccttgctagaagccagtggcatgctcttgaacttcccagcctgcagaactatgagctaaaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcatt

SEQ ID NO: 199130 - DNA, 2338 bp, Homo sapiens
  Payload ID: 19283
  Gene Name: vezatin, adherens junctions transmembrane protein
  ENST ID: ENST00000548838
  CDS Start-End: 53-250
actcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaaggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacgggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatac

SEQ ID NO: 199131 - DNA, 648 bp, Homo sapiens
  Payload ID: 19283
  Gene Name: vezatin, adherens junctions transmembrane protein
  Uniprot ID: Q9HBM0
  ENST ID: ENST00000550803
  CDS Start-End: 106-345
gtagttttctggacccacgggacgggcaggagctggagctccgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggtggagccatctcattcttcagtgatactaggactgtggtaaggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaaccccta

SEQ ID NO: 199132 - DNA, 3002 bp, Homo sapiens
  Payload ID: 19283
  Gene Name: vezatin, adherens junctions transmembrane protein
  Uniprot ID: Q9HBM0
  ENST ID: ENST00000547997
  CDS Start-End: 91-330
cacgggacgggcaggagctggagctccgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 199133 - DNA, 566 bp, Homo sapiens
  Payload ID: 19283
  Gene Name: vezatin, adherens junctions transmembrane protein
  ENST ID: ENST00000549002
  CDS Start-End: 90-566
acgggacgggcaggagctggagctccgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaagatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggagg

SEQ ID NO: 199134 - DNA, 608 bp, Homo sapiens
  Payload ID: 19283
  Gene Name: vezatin, adherens junctions transmembrane protein
  ENST ID: ENST00000551472
  CDS Start-End: 42-608
catttcccatcgtgctgaggcgggtggcatggcggagaaggatgacaccggagtttgacgaagaggtggtttttgaggttcggccagtgggaaggacctgcagatcagaggatggaggaaagagcgccagagagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctg

SEQ ID NO: 199135 - DNA, 565 bp, Homo sapiens
  Payload ID: 19283
  Gene Name: vezatin, adherens junctions transmembrane protein
  ENST ID: ENST00000551311
  CDS Start-End: 298-565
agatagtcacaacttagcctcctccttttccatccgcgatttttttgggtcagtatccagagtgcttcaggtcactgttcaccgtcaaggcgtggccctcggaatgaaggcagcagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgct

SEQ ID NO: 199136 - DNA, 2575 bp, Homo sapiens
  Payload ID: 19284
  Gene Name: VGF nerve growth factor inducible
  Uniprot ID: O15240
  ENST ID: ENST00000249330
  CDS Start-End: 241-2088
gcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgccccccgcccccgctcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttattagga

SEQ ID NO: 199137 - DNA, 2477 bp, Homo sapiens
  Payload ID: 19284
  Gene Name: VGF nerve growth factor inducible
  Uniprot ID: O15240
  ENST ID: ENST00000445482
  CDS Start-End: 150-1997
agatggctcagggaaggggccgaggaggccctgggtaagcgagggcttcgggggttattttcccatttacacggctccagagatcggcacaacatcttcctcctttgctcctaaacgttcctcttctggtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgccccccgcccccgctcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactatttt

SEQ ID NO: 199138 - DNA, 1622 bp, Homo sapiens
  Payload ID: 19284
  Gene Name: VGF nerve growth factor inducible
  ENST ID: ENST00000611537
  CDS Start-End: 206-1339
gccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtttgctgcagggcggggcccggcagcgcggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttattagg

SEQ ID NO: 199139 - DNA, 6531 bp, Homo sapiens
  Payload ID: 19285
  Gene Name: villin 1
  Uniprot ID: P09327
  ENST ID: ENST00000248444
  CDS Start-End: 89-2572
acaaaggtcgctcttctgcagccagcttgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaaggagcctatggtcctcatttcaacttctaaggtcgctagattgtttctatcctgaggtattgcatcaattttaatactcctatagttttctcttcttagaagagcacaaacactccatggaacattagagttctgaggcactaccctagcttgtcctctatcatgactcatttttatctatggcaggtaggctgaagcactttgcaggtttacatcttccccagagtaacagcttttccttttcacatatactttccttactgccttactcagtgggtaagttaaagggctgaaggagagttgaatggtccacaagactaccctcttaagaggtttcacaaattccaaacagtaccagtgagagcagcacttccactggggctaggcttgagacctaaaggcaagtatgaaatgcatatgctacttcactccctctcccaacccttaataatgaggcaaagcaagagcctagtgaaggccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacacaaaaaaactctatgcataatttaaaaaggaaacaaaaacaaagaaaaaccgtaaaggatacagaggaacagttctgctaaaacacagataaaagtgccgctccatacaaaacataaagaatcagaatcaaaagtcactctgaacataaagaaaaaaaatcatctcacaaataatgtggccacagctgccagaaaacctggtagtggctcaattaggcaaagtgtaggaatctcatttttgtttttctctccttaagtttaaagaaacaacaatgacaataggccagagaagttagggagggaaagaaaagctcaaagggagggaaacctggggacaagaggtgtgcacacccacatgtggtctcactcttcacacaggcccactatttttgaagtagaccagtttagttgactgttcttctttgttctggcatctgactggaccaacctggaacctggtccagaccctcacccactctattcttatgccaatggacatacctatactttgaacctctgtacttttaagaaaagtccaatgttacaaaatcaaatgcttatattcagactggcacactttttaaataaaaactccatacacctcagacatatagcacacatggagacaacttactaattgtgtgtaagtatgatacaatgaatgagactgcctgaagtctagtaatcaaagcatgccataaggtgaatgattgtggttaaacacagcaaaataattgtcacaaaactttcaaggcctaacaaattagaattttccaataaaaaatatatattttttcagatgttaataagacatatcagtagagacaaaattaggattttgaagtaatgcaataaaaagatgttggagggcagaagtctatttagtttttgtatacacttgcaagagtgcattactcagtataaagcaaaatggggaggaaaaagacatccatccattttattggaacacttttatgtgacttgaatctggtgttaggttgttgatttttctaaaaatctcctatatatacaaaatccatatgtacttggagatccagctgttgccccctgtttaaaacaaaagaccacctcggggggtcaattaaattaaaaaggccctccaaccaccctaaatgggataactaagagtatctactgcagtcatttcagaggacagagaaggaaaatattttaatttgctttaatataacctcttttcagtagatcacaaatgagtttacaaactacttttttttctctttaatttaggtgtttgcagataattttcattatatccgtagctgtatgtgtgtatagttacataatggtaactacacacgatacagaagaatcagtaaattcatggattattttgctgaggttttaaattttaaagcctctgtttcagaattttatacttgatcaaggagaaaaataaatgtgtagtctaacatttgctttctggagttaattaactgatctgtaagaaccactgcatatgtcttaaaatgtaaacatatttacatttgttgtatttgttattgagcctttaaggttaggcccagaatgaacagaccatagcaagtaaacaaataatttttagaatcaaagtattaatagaagaccagttcatggatttgcttattctatcctgctgagacaaaactcatgagtgtgcacacacatgtgaatatatccctacgaaacagtctatcttctcataggcttaaattatagtcatggctattaaagaaattaacagcatccagccacatgcaactttccaaccttcagtactattaggtgattaaaatcaacaaatatgaagtttagttcatttttcccttaaaattccaacaaagatcaaaaggttgtatctagaactaattgccatcaagttccaattcaatgtcatttaaagtaatgtaaccacacatttggtattttcaataggaaggttaattaggtattgtgcaaactgcctgcaacggaagcactcagtccttatctaacttgtcccttcctggccccaacatgctaactgccccatccccaattctgggcaaactgatcacaatgtgcaaaaaataatatattatctatttataattttaaaatatatacagccagctcaaaaacaacaacaaaccccatcaacatagtccagctgaaatctccactggtagtcaaagaagtagattaaaggagtaaaggaaggagaaggctgatagggccacaagaatggacagacatcaagtaaaatttgagtcccaaacatgcaagtacatgagcagtgagataacttatatattccaataacctattttcaacaactcctgcccaagacatgaagatcaaatcaggtttctgaggtaagtgtacttctaaaccatacacacatgaaagctatgaaagcaattcaaatgaggctgcttcatgaggcaatctagacttatggcattatttctacttttctccatgttttaattgcagcctgcactttaaatctttcccaataatttttaacagtgcctctcaaatgcaaagacacgtaaaagaattaataactagccaaagaattttatcaccgcttcactcatttataagaaaaccaattatttccaagcaaaatcaaaccaaaccaaagaggctcctggtagaaatgaaacaaaactttaaagctagttttaaaacaaatattttcctctgctctaaactactctggcgttttctaccactctaccattttggaacattcattacaataaggtatataggtagatggtaggaggcaaagcatttatcagtagttgagcaaaactgctgaggccatttataattcaaagaatgaaaacttagaatagtttactacattagaatacatccaagttccaagagtaggactggagctctcttaaggcaatctttcagaaaagatgttgcatcttctgtgatgatggtttgtgttttttttgtttttgttttcgttttttttaatgagatggagtctcac

SEQ ID NO: 199140 - DNA, 1968 bp, Homo sapiens
  Payload ID: 19285
  Gene Name: villin 1
  ENST ID: ENST00000392114
  CDS Start-End: 230-1780
acaattccctgagatctcccaggtggcagctgcctccccaagacaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaagg

SEQ ID NO: 199141 - DNA, 639 bp, Homo sapiens
  Payload ID: 19285
  Gene Name: villin 1
  ENST ID: ENST00000419986
  CDS Start-End: 1-639
ggagcagaaaggaaaggaggaggtttggggttaaggctggggttgcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttg

SEQ ID NO: 199142 - DNA, 1454 bp, Homo sapiens
  Payload ID: 19285
  Gene Name: villin 1
  Uniprot ID: P09327
  ENST ID: ENST00000440053
  CDS Start-End: 15-1280
caggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtgggtgagggccaggcgggggcagtgagggagccaggatccaggagctgggccaggagagccacttggtccaccacccaccctccttccctgacgtgcatcttcaacgaagacttttacgctggctctgggcttgtcctagcagatggggacgtggacaaactctagttgtcacaaaaagggagctgagagggctgggcatggtggcacatgcctgtaatcccagcactttgggaggctgaggcgggtggatcacctgaggtcaggagtttgagattagcctaacatggtgaaaccccgtctctactgaaaaaaagaactaataaattagccaagcatggt

SEQ ID NO: 199143 - DNA, 532 bp, Homo sapiens
  Payload ID: 19285
  Gene Name: villin 1
  ENST ID: ENST00000454069
  CDS Start-End: 60-532
ccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagatccggaaagggggcgtggcttctggcatgaagcacgtggagaccaactcctatgacgtccagaggctgctgcatgtcaagggcaagaggaacgtggtagctggagaggtagagatgtcctggaagagtttcaaccg

SEQ ID NO: 199144 - DNA, 2970 bp, Homo sapiens
  Payload ID: 19286
  Gene Name: villin-like
  Uniprot ID: O15195
  ENST ID: ENST00000283713
  CDS Start-End: 267-2837
gagggcgggaagggccctctgtggggctgccattttggctgggacctaaatgcagtaaaggagcagctacgggaatatagagagtggggcttccaggcagagaagcctgcagtgcaaaggtctgcagacaacgacctgggcgtcttcaagggacacaaggaatcatattgccagaacacattgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccatacga

SEQ ID NO: 199145 - DNA, 2787 bp, Homo sapiens
  Payload ID: 19286
  Gene Name: villin-like
  Uniprot ID: O15195
  ENST ID: ENST00000383759
  CDS Start-End: 87-2657
ttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccata

SEQ ID NO: 199146 - DNA, 813 bp, Homo sapiens
  Payload ID: 19286
  Gene Name: villin-like
  ENST ID: ENST00000412008
  CDS Start-End: 1-305
gcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggagggcctacctgggatttgaccagagtccgcctggctccaggctctgccacccacaggaagaagaaactacactgacagatgtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcaca

SEQ ID NO: 199147 - DNA, 582 bp, Homo sapiens
  Payload ID: 19286
  Gene Name: villin-like
  ENST ID: ENST00000416303
  CDS Start-End: 191-582
agttacagtggtggggaccaggagtagggaggcagagactggccccgtgccaggcctagcactgcccacaggcagggcgaaggcgcgggagcagtttccagcagttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaactt

SEQ ID NO: 199148 - DNA, 1857 bp, Homo sapiens
  Payload ID: 19286
  Gene Name: villin-like
  ENST ID: ENST00000465644
  CDS Start-End: 27-1751
cggaagcccctgcctagcgtctccccatggcccttggtacatcctccccttctccacccgcacctccgtcttccccgcaacacatatacacaaacacccggaccctaggtcccccagagcccgaaggccacgcagggggcggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgt

SEQ ID NO: 199149 - DNA, 686 bp, Homo sapiens
  Payload ID: 19286
  Gene Name: villin-like
  ENST ID: ENST00000492491
  CDS Start-End: 126-686
agggcggcaccactccctgctccatggaaactgagcaagttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgg

SEQ ID NO: 199150 - DNA, 1868 bp, Homo sapiens
  Payload ID: 19287
  Gene Name: vimentin
  Uniprot ID: P08670
  ENST ID: ENST00000224237
  CDS Start-End: 146-1546
ctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 199151 - DNA, 753 bp, Homo sapiens
  Payload ID: 19287
  Gene Name: vimentin
  ENST ID: ENST00000421459
  CDS Start-End: 1-522
ggtttcctcgttcccctttggttaatgcgcaactgtttcagattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccgtgagtaccaaccctgcagtaaaagagggaaaataatgacccattctgctgactaggctcatgatgatacctgaacaaaatgttgagtgagtaaaaatgtatatcataatgcaaagaaaatgagttatcaagacagactcaaaagggacttcatggaactcttgaaggttttagcttgcctatatcattgcttctaatatgaaggacttggtactcgcattctccacctaaaattagagtggtcgccatttgccgctaatggaaatt

SEQ ID NO: 199152 - DNA, 2666 bp, Homo sapiens
  Payload ID: 19287
  Gene Name: vimentin
  ENST ID: ENST00000469543
  CDS Start-End: 630-1316
aagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacagatttcttaaaactaccactttgtgtgcagttgaaggcccttgggcacaatgagagccagtcctccaaactttcagaaagtttcctgccccttctggcaggctgccaatcaccgggcgggagaaggaaggaggggaaggcggtggagggagcgagacaaagggatggtccctcgggggcggggatggcggggctgtcctgtaggtctgtgcggccaccgtgattgcccctctgcgcggtgcccgaagtcccgctgaaacctgccgagggcagcaggtctgaaagctgcaggcgctagttgcgcggaggtggcgcagctgctctggaggcgcagagcgaatacgtggtgtttgggtgtggccgccccgcccctggcggtttcctcgttcccctttggttaatgcgcaactgtttcagattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggtagggaactcagacttggatgcgtgaactaatggtgaccatttgttaggccctgtgccactgggctctaagcagtgtcacatttaatctttagaaagtttctttgaggtaactgctttccactttttgtagaggaggaatttgaattgagagagagtaagtgacttgctgaaaaagggttaatcaacagcagagctgggatttgaacccataactctgtcaaagcctccactcctaactcctgttcatgctcctgtggagaaaatgcttgtagtaacatattttaaatgtactaacaagaccagtcatgggaaaatgtttctgagacaaatctctagtttatgatttaaaacagtacgttttcttacgtgacgaaaacaaaaagtgtgttaatttgttcccagtggttgaagttatttgccaacaattttactgtttctcttcatctgtttataggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 199153 - DNA, 2272 bp, Homo sapiens
  Payload ID: 19287
  Gene Name: vimentin
  ENST ID: ENST00000487938
  CDS Start-End: 146-1441
ctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 199154 - DNA, 2128 bp, Homo sapiens
  Payload ID: 19287
  Gene Name: vimentin
  Uniprot ID: P08670
  ENST ID: ENST00000544301
  CDS Start-End: 414-1814
gcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccgctgagacttgaatcaatctggtctaacggtttcccctaaaccgctaggagccctcaatcggcgggacagcagggcgcgtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttgg

SEQ ID NO: 199155 - DNA, 2254 bp, Homo sapiens
  Payload ID: 19288
  Gene Name: vimentin-type intermediate filament associated coiled-coil protein
  Uniprot ID: Q2NL98
  ENST ID: ENST00000339485
  CDS Start-End: 34-543
gggcgtggccgggcctgtacagcagcctgggccatgtcggcgccgccggccctgcagatccgggaggcaaacgcacacctggcagccgtgcaccggcgcgcagcggagctggaggcgcggctggacgcggcggagcgcacggtgcacgcccaagccgagcgcctggccctccacgaccagcagctgcgcgccgccctagacgaactgggtcgcgccaaggaccgtgagattgccacactccaggagcagctgatgacctcagaagccactgtccacagcctgcaggccaccgtgcaccagagggacgagctcattaggcagttgcagccccgggctgagctgctgcaggacatctgccgccgccggccacccctggctgggctgctggatgccctggctgaggctgagcgcctggggcccctgccggccagtgaccccggccacccaccccccggtgggcctggtccaccccttgacaacagcactggggaagaggcggacagggaccacctccagcctgcagtgtttgggaccacagtgtgagcccggaatgcagattacagaatggagacagaaagccactgctgtcagtgtccttgggagtcaccagcaccctgcagggggaccctacggcagagccaaagtcctgtctaagcatcagaacaggctgaacagtcaaaaagttttcaaataggcccacaggccaggtgcagacgtttaacccagacagaagtgttcttgtttgtttttaagctttgaatcagtcacccttgctaaaaacctggcaatgcaaacacaaagatctggatttctggcaagacttggccaagcttgcctggagttcagggcaccctctttagccagggtgtgagtttctgttttttgtttttttttttttaagacagagtcccactctgtcgccctggctggggtgcagtggtgcgattttggctaactgcaacctccgcctcccaggttcaagcgattctcctgtctcatccttcagagtagctgggattacaggcgcccaccaccacacccggatattttatatttttggtagagaccggggaggggagggggtttcaccatgttgaccaggctggtctcaaactcctgaccttaggtgatccacccgcctcggccttcgaaagtgctgcagttataggtgtaagccaccgcgcccggccctagcctagcttttgtagcatgcaactgtctcctttttatacgccctaaagaatatatttttgaactccttgtttctgcgctgtccttcttagcccaggacattcagggtgctttgcttgttgtcaaaccagggaaaggagaaaactcctgtgcctttctgggccagcctgtcaccctggcctggtcggcagccattcccctacctcctcactcaggaactgtcacaccaggaaccggcgaggggcacagcctgtttcagaccagaaaggtcggaggccacccacggccttcaggatggcgcccgcctgcctgcctggcaacagtgacccctcagtgcagtaacaatgggcccattttctcctctggatgaacaaggaggggggttgtttgtacaaaggaaaggcaggctggggcctgtctgtgctcaagaataaaccggatgatttcctggcctgggggcaagagggaggccctctgtgttatttgtgcctcctggtagggtcctgctgggccaggtagaatctagggagtgtaggccaagcactctctacagcgattgcatctaatcttcgagtttccctgtagacacaggctttgtcctcattttacagctgtggaaagtgaggcccaggccgggcgcggtgtctcacgcctgtaatcccagcactttgggatgcgggtggatcacctgaggtcaggagttcgagaccaccctggccaacatggtgaaaccccgtctctactaaaaatactaaaattagccgggcttggtggcgggtgcctgtaatcccagctactgaacccgggaggcggaggttgcagtgagtggagattgcaccactgcactccagcctgggagacagagtgagactcagtctcaaagaaaacaacaacaacaacaacaacaacaacaacaacaacaaacagaggcccagaggtgtgaagggaacacactccgggtctggagggccagggccacttccaattctgggggaagttattgctgaaattctgttttctttctttctttcttttttttttaaagagacaaagtctcactgtt

SEQ ID NO: 199156 - DNA, 5482 bp, Homo sapiens
  Payload ID: 19289
  Gene Name: vinculin
  Uniprot ID: P18206
  ENST ID: ENST00000211998
  CDS Start-End: 95-3499
gtagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgt

SEQ ID NO: 199157 - DNA, 6489 bp, Homo sapiens
  Payload ID: 19289
  Gene Name: vinculin
  Uniprot ID: P18206
  ENST ID: ENST00000372755
  CDS Start-End: 95-3295
gtagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaaatgctttaaatgatggatatgttactttagcaagaacttttaggtcaggtttctcctttgttttgatgaatagtcaatgaaactaatcctcaagatctggaaactaaagatttttatttaatccaaatgttgcactggaagaagaaatcaacagtggtatatttacttaacaaggatgtgtgtaatacaagacaaccctggggattacacacttgaaggaatggaagtggcaaaggttaacaggcagaaagcagctggatgaaacagtttattttcatcttagaagattctagctatctgtggagaccaccactgttccccgaaaagctaaagttgttaagtttgtaggagtaccacaggtccttccccctgctgcaagacagagacttgctctgttgcccaggctgcagtgcagtggtgcaatctcagctcactgcaacctctgcctcccgggttcaagcaattctcctgcctcagcctcccatgtagctgggattacaggtgtgcgccaccatgcctggctaatttttgtatttttagtagagatggagtttcaccatgttggccaggctggtctcgaactcctgacctcaagtgatccgcccaccttgacctcccaaagtgctgggattacaggtgtgatccaccacgcccggccacacaggtccatttttcatattccaaagcccagtatagaataaatagggttttcagggatccaccagggctataaaacagagttagcttttggggacatagtcctcttcttccttaaagaaacactgactaaaatagtaggagcaggtttttagagtagagttgggacatcactttttccctgattttctagatctgaaaggggtaacatgtcattaaagggtgatgatattgatatttagtgttgccaactgctattatcactgctttatcttggaaagttgccgactataaagacagattccagcctgcttgagttaagggaaaggccaaggctgctactgaattagcagtttctaaaactgtcttgtttttgccatttaccatatgttcactggtgctgccttcctgctgtagtataatcattttctcaaatcagttgcctctcaggacaagatcagcattttcctagggtccttctgtagcaccacttaaggaatgaacctatcacaggaactccctttgaataaaatgatggtgactccca

SEQ ID NO: 199158 - DNA, 4412 bp, Homo sapiens
  Payload ID: 19289
  Gene Name: vinculin
  ENST ID: ENST00000436396
  CDS Start-End: 1-2421
gggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaaa

SEQ ID NO: 199159 - DNA, 3307 bp, Homo sapiens
  Payload ID: 19289
  Gene Name: vinculin
  ENST ID: ENST00000624354
  CDS Start-End: 95-268
gtagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccggggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgc

SEQ ID NO: 199160 - DNA, 1892 bp, Homo sapiens
  Payload ID: 19290
  Gene Name: visinin-like 1
  Uniprot ID: P62760
  ENST ID: ENST00000295156
  CDS Start-End: 272-847
gcgcatccagctccagggaccctaggttttctatgggattcccaatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtga

SEQ ID NO: 199161 - DNA, 992 bp, Homo sapiens
  Payload ID: 19290
  Gene Name: visinin-like 1
  Uniprot ID: P62760
  ENST ID: ENST00000404666
  CDS Start-End: 283-858
caaccttcccgaggcgtcctgcccgggaagccagttcctgggttctgggctggctaggttggcagcgaatgaggcttaggcatcactgcctgaggccctcacttagcatgtcgacagccacagacttgtctggcggagtttctcctggtgcccacttaagtagtctcaagtttgttcaaagctggactcctcgacttggaaccaggagcagctggagatttgtcaatttagagctcatttgccacgggagacgctcttggtgtccccagcaccgaaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatgg

SEQ ID NO: 199162 - DNA, 2725 bp, Homo sapiens
  Payload ID: 19290
  Gene Name: visinin-like 1
  Uniprot ID: P62760
  ENST ID: ENST00000406397
  CDS Start-End: 526-1101
agactagatttaagacaggtgaaactgagatgctttcttagtttgtcttagacagatttaagtagctaattgaccgattgtgaagttttccggttgctgataaaactattgagcgggtacagtcgagtagcaacctgtcatccgtgggattggtgcaccatttttctcactgtggaagggcagcaaaggtgtttgctaagtaaaactgagtggatgagattggtatggaaatcatggttgatctctgagcgggatgttagtgtttaagatccacggagtcaggcgcaaaatgagcacatttctctcagtattcagaaatgagtagataatttttttcgtctttgatttttgtcacaatggtgaatgggcagaaaagggaaagatgctctactgcactgtcgattttgaacggagtcacaggctcggtcgctgaatggggactgtcagacccaaactagttacctgcctttgcattccgtgttcgccatccggaatctggggttaaaaaatgtaaatcaaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgactttggtgctaacaacgtatgttcagtgcaactacgtggagctgtgcacacacagcaggtaggctgcaggtgtcccccaacataagtcagtaggaaagaagacatctgtcttcccaaatctaaagtaggcaaaaaataacagaagtagctatttttaataacagaacagaactctgactcttttgatcttgaaggaggcagaagagattccatcaaaacctctaaaagcaggtttgcattttcagaacatgcccccctagagagttgagttttttacacagcactacccggtagtactttctctgatgatgggaaggtctacatctgcacagcacgctagctataactgcacatatggctactgagcacttcaagtatggctagcgtgactaaggaactgaattttatactgtaattaagtgtaatttgccacatatagctagtggctttagtaacagacagtttagtgctatattatttattcaagtactttttatcaaattcgttttttaccgaattcgttttttaccattctttatttgtcttaggatcattacataacactaaactagggtctaa

SEQ ID NO: 199163 - DNA, 562 bp, Homo sapiens
  Payload ID: 19290
  Gene Name: visinin-like 1
  ENST ID: ENST00000451533
  CDS Start-End: 250-562
aatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgacttactggattatttccaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggcct

SEQ ID NO: 199164 - DNA, 576 bp, Homo sapiens
  Payload ID: 19290
  Gene Name: visinin-like 1
  ENST ID: ENST00000457525
  CDS Start-End: 222-576
agtgcatacagaaggcgcttggctcagggtacacagggcaagaagcctcggatcccagctccctttaacacacattttttcaacgccgttctggaccgagactgtccggggcactgggtgctgcaggacccggctcccagtactcctagcagaagaccctctgatgaaatggcccatgacaaaatgaccaccataaccgttccttcagtaagccaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgag

SEQ ID NO: 199165 - DNA, 943 bp, Homo sapiens
  Payload ID: 19291
  Gene Name: visual system homeobox 1
  Uniprot ID: Q9NZR4
  ENST ID: ENST00000376707
  CDS Start-End: 36-755
tccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtgtctggggtcccttttctccgctccaaagataccacagagaacgtgtcattcccacattcagtgagccaatcagcagtcccttctctatagccaacacgctccctttgcatagaaactgagggtcccttagctgaaggcaccacaagagcttgcccctatgaccctcatgccttttttcattttattattatttagtatcaaatcattctttaaaatcacatgataatgtgtgctgcaactagaaactataaagatatgtcaatgaaaaaaaaaaaaaa

SEQ ID NO: 199166 - DNA, 2192 bp, Homo sapiens
  Payload ID: 19291
  Gene Name: visual system homeobox 1
  Uniprot ID: Q9NZR4
  ENST ID: ENST00000376709
  CDS Start-End: 270-1367
ggggtggggtggggtgggctggacagaagagaggaggagaaggaggtgactgaggggactgcagctgggtgggcggtaaccgaggggaggggaactggtggcgtccccatctcgcggggtccggaacggcgacgcgcccgcgcccagctgattggagcccttcaggcctcccgcgcccgaccggcagcccaatcctataaagcttcctctaagctgggccctccgcaaacgggatccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtctggtttcaaaaccgcagggccaaatggcgcaagcgggagaagcgctggggcggcagcagcgtgatggccgagtacgggctgtacggggccatggtgcgccactgcatcccgctgccagactccgtgctcaactccgccgagggcggcctgctgggctcctgcgcgccctggctcctggggatgcataaaaaatccatggggatgataaggaagccaggaagtgaagataagttggcaggactctggggctctgaccacttcaaagaaggttctagccagagtgagtcaggatcacagagaggctcagataaagtgagccctgagaatggcttggaagatgtggctattgacctctccagctctgcccggcaggagaccaagaaagtgcaccctggggctggtgctcaaggaggctccaactccacggcactggaggggccccagccagggaaggtgggagccacatgagacccacaggtcccactgtcaaaggctgaaaatgtgcatattcctcactggcattttccaaaagacaaaaattgtccaagacatatactctcagtttgattttcttctgacaatgtcaagataaaatgcaatgccacttgctttaagaggacagatgagtgacctagggaaaattctatttcattctagaatggaaacggttccttaatggcactttaaccagttaacttggtgcaaaacttttgattctcttttgtagcttgagcagggaggatccgaagttcaaaaatgatttcactgctgggcatcatttgagatgtgtggttcaatgtactgtatagatgaataggttaggtctgatgtcctcattctcaattaggaaatataaaattgtttaatatccagaagaatctgatatcatcatagtgaagactccatacagacacatgaatgaattatattgtctttaccttgaacttggccttggatatttcaattttcttgttagggagtaattttgtgttttcttgagtgtcacttgataggctatgcatattggaattcaaagaaacccatactctagtcgtttctgcatttcctttaaaaatagcatgggatcatatttaaacaattgttggatagctggaaacagtgtttttaggtcagaccaggcttttggtctttcaaaatttgtgattgaaagcactttagtgacttggattttgtaaatctttcctttcctgcgtttcctttgccatttatttattctttaaaaataaacattttgtggtgtgtttacttttcaaggcactcctctattacaca

SEQ ID NO: 199167 - DNA, 1486 bp, Homo sapiens
  Payload ID: 19291
  Gene Name: visual system homeobox 1
  Uniprot ID: Q9NZR4
  ENST ID: ENST00000409285
  CDS Start-End: 36-878
tccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtctggtttcaaaaccgcagggccaaatggcgcaagcgggagaagcgctggggcggcagcagcgtgatggccgagtacgggctgtacggggccatggtgcgccactgcatcccgctgccagactccgtgctcaactccgccgagggcggcctgctgggctcctgcgcgccctggctcctggagggtgagacattgggctgcagagaaatgaagtgaacctgctaagccgattgtcaaatggatgagaaactcagagccaaggatcgggaaaacacccttaaagaacgagtgcaaacttctgctcctggaggctcccgttcactggactttgcaggagacacacaggctccccagaccccgtggtggtgcctgatgaccttcagctgaaccctgtaatgctgctaaagtctgcccctctggagaagtgctcaggtagcattgttctgcctcaggaagcatgccgattttcctgtgtcatccttgatgatcactgctaccagacttgccccctgcagggcaccccatgtgcaaggaattcaacaacctaggagttgaaagcattggtctcccaagttcagtgtgttcttttccgtatctattaccagctgatgagaataaacctgcagtcatgacagctaggtcctagtgacaggtgcagaaagctgctcttacagaaactcccctccttattaagaggctttgtctatcactcggaactgcttctactcaagattatctgttgaaagggaactgtccataccagggcattgttctgacttttctggacttcctcaacccaaaatgccttgaagaaaaaaaaaaaa

SEQ ID NO: 199168 - DNA, 1305 bp, Homo sapiens
  Payload ID: 19291
  Gene Name: visual system homeobox 1
  Uniprot ID: Q9NZR4
  ENST ID: ENST00000409958
  CDS Start-End: 36-692
tccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacagagggtgagacattgggctgcagagaaatgaagtgaacctgctaagccgattgtcaaatggatgagaaactcagagccaaggatcgggaaaacacccttaaagaacgagtgcaaacttctgctcctggaggctcccgttcactggactttgcaggagacacacaggctccccagaccccgtggtggtgcctgatgaccttcagctgaaccctgtaatgctgctaaagtctgcccctctggagaagtgctcaggtagcattgttctgcctcaggaagcatgccgattttcctgtgtcatccttgatgatcactgctaccagacttgccccctgcagggcaccccatgtgcaaggaattcaacaacctaggagttgaaagcattggtctcccaagttcagtgtgttcttttccgtatctattaccagctgatgagaataaacctgcagtcatgacagctaggtcctagtgacaggtgcagaaagctgctcttacagaaactcccctccttattaagaggctttgtctatcactcggaactgcttctactcaagattatctgttgaaagggaactgtccataccagggcattgttctgacttttctggacttcctcaacccaaaatgccttgaagaaaaaaaaaaaa

SEQ ID NO: 199169 - DNA, 1197 bp, Homo sapiens
  Payload ID: 19291
  Gene Name: visual system homeobox 1
  Uniprot ID: Q9NZR4
  ENST ID: ENST00000444511
  CDS Start-End: 36-746
tccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacagtgcaaacttctgctcctggaggctcccgttcactggactttgcaggagacacacaggctccccagaccccgtggtggtgcctgatgaccttcagctgaaccctgtaatgctgctaaagtctgcccctctggagaagtgctcaggtagcattgttctgcctcaggaagcatgccgattttcctgtgtcatccttgatgatcactgctaccagacttgccccctgcagggcaccccatgtgcaaggaattcaacaacctaggagttgaaagcattggtctcccaagttcagtgtgttcttttccgtatctattaccagctgatgagaataaacctgcagtcatgacagctaggtcctagtgacaggtgcagaaagctgctcttacagaaactcccctccttattaagaggctttgtctatcactcggaactgcttctactcaagattatctgttgaaagggaactgtccataccagggcattgttctgacttttctggacttcctcaacccaaaatgccttgaagaaaaaaaaaaaa

SEQ ID NO: 199170 - DNA, 1977 bp, Homo sapiens
  Payload ID: 19291
  Gene Name: visual system homeobox 1
  Uniprot ID: Q9NZR4
  ENST ID: ENST00000429762
  CDS Start-End: 36-941
tccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtctggtttcaaaaccgcagggccaaatggcgcaagcgggagaagcgctggggcggcagcagcgtgatggccgagtacgggctgtacggggccatggtgcgccactgcatcccgctgccagactccgtgctcaactccgccgagggcggcctgctgggctcctgcgcgccctggctcctggtgcaaacttctgctcctggaggctcccgttcactggactttgcaggagacacacaggctccccagaccccgtggtggtgcctgatgaccttcagctgaaccctgtaatgctgctaaagtctgcccctctggagaagtgctcaggtagcattgttctgcctcaggaagcatgccgattttcctgtgtcatccttgatgatcactgctaccagacttgccccctgcagggcaccccatgtgcaaggaattcaacaacctaggagttgaaagcattggtctcccaagttcagtgtgttcttttccgtatctattaccagctgatgagaataaacctgcagtcatgacagctaggtcctagtgacaggtgcagaaagctgctcttacagaaactcccctccttattaagaggctttgtctatcactcggaactgcttctactcaagattatctgttgaaagggaactgtccataccagggcattgttctgacttttctggacttcctcaacccaaaatgccttgaagaaaaaaaaaaaagaccctgagtgttagggcagggtctcactctgtctccaggctggagtgcagtggcacaatcatagctcaccgcaacctctaactcctgggctgaagtgatcctcccacctcagtctcctatgttgctaggattacagcgtgagccactgccccagctactccaacttaagagttcccccaaggctggctgcccttctcctctccttccatcatgaatgacacatgggcatccccttcggctagcatggctgacctgtgcctgcctgggtgctcagcttggcacccatgtgagtttgcagcctgaaattttaaatggaggagtttctgtgcttttctgccctgattcctcttactgaccctctaagtcaccagctgtggtcgtctcctctttgacccctgatctcaacccgggctttgaaatgtgtttgttcacataattgtccattacccatccttcctgtcattgcagaatctgttgtctcatactgacattttaagactttttttcactttcttctgttgaagatcacctactaagaagtacttcctccttttcattctttctttataagaattaattaaattttaattgacaaaaa

SEQ ID NO: 199171 - DNA, 2995 bp, Homo sapiens
  Payload ID: 19292
  Gene Name: visual system homeobox 2
  Uniprot ID: P58304
  ENST ID: ENST00000261980
  CDS Start-End: 91-1176
cctgggaccaacttcgcgaagcgggaagcccggcgggggggtggggggagctaaagacctgcggcctcagcccctccaaagaacagggagatgacggggaaagcaggggaagcgctgagcaagcccaaatccgagacagtggccaagagtacctcggggggcgccccggccaggtgcactgggttcggcatccaggagatcctgggcttgaacaaggagcccccgagctcccacccgcgggcagcgctcgacggcctggcccccgggcacttgctggcggcgcgctcagtgctcagccccgcgggggtgggcggcatggggcttctggggcccggggggctccctggcttctacacgcagcccaccttcctggaagtgctgtccgacccgcagagcgtccacttgcagccattgggcagagcatcggggccgctggacaccagccagacggccagctcggattctgaagatgtttcctccagcgatcgaaaaatgtccaaatctgctttaaaccagaccaagaaacggaagaagcggcgacacaggacaatctttacctcctaccagctagaggagctggagaaggcattcaacgaagcccactacccagacgtctatgcccgggagatgctggccatgaaaacggagctgccggaagacaggatacaggtctggttccagaaccgtcgagccaagtggaggaagcgggagaagtgctggggccggagcagtgtcatggcggagtatgggctctacggggccatggtgcggcactccatccccctgcccgagtccatcctcaagtcagccaaggatggcatcatggactcctgtgccccgtggctactggggatgcacaaaaagtcgctggaggcagcagccgagtcggggaggaagcccgagggggaacgccaggccctgcccaagctcgacaagatggagcaggacgagcggggccccgacgctcaggcggccatctcccaggaggaactgagggagaacagcattgcggtgctccgggccaaagctcaggagcacagcaccaaagtgctggggactgtgtctgggccggacagcctggcccggagtaccgagaagccagaggaggaggaggccatggatgaagacaggccggcggagaggctcagtccaccgcagctggaggacatggcttaggtcaaggcgcgctcagatgccggagccccaagactctgctctcctcgggccctgtggtgctgggagatgctctctgaggcaaggcccagacctggcctctgccatcctccctgttccccacaggtcctccatcacccctggtggctgcaggcaccgctgggttctgactctggaccatgctgagacatccctcatctagtcttgacctctccagcatcccagcctcagaagccttcttgctgcccacaacgtcccctcaagccccttctctcaatccctttgcaacgctcactggttttggccaccccttgctctctgttctcttgctttaaagagtcctccttcccagctctacattctgctctgcccatgcctaaagcccattgctgcaaatgcattgtgaattgcctgccatggctgtgacacagacggaggactggaactgcaactccagcgtcctcagcaccccactcctcagtaaaagtcttctcccaactcagcctgttccttcctgcagacctggctgggcctgggcttccacagtgtgaagacactgtgcaggcccaggcaggcccagcctctgccccacccatcagtggagtccagatggcaggctacagttgggaagtctcagcctgggcccctcagccacccttggtctcatgccccgccatggtcaccctcaggaacccaccctctccacacccagcctgtcccactggctcctcccagcacaggcacctatgtggcatgtggtgatgtacgctgcgtgccatgagtccatgtcctatgcctcacaaatgctgtggttcactgcactgttcaggagtccaaaccttctaccctgggtcctcgggcccctgagcctgtgtcctgaagaatctcgactctcgtgatatgctgcttgtgaccttgacttgccatgaaggcacctgcccccacagctccttgcaaactatgagttcacatgtgccctgccttgaacaacccaatctggctggtaaatgacatctacgaagccacaggcctggcctcaactgagaagccaagcctggagtaggcctggggctatgcatacgcattaagggcctgctggagaaaccttcactccagacagacagggggctaaggggctagggctgagcacctctcagagcaagcctttgacctgttcagaaggatgggaaaaaggctggaaggaaagcaaggcagaaggccaggagtaagcccaagctaagctgcaggcacacacgccttcatgccagtgcatgccaggaagcacgttcactagactaaaacacggtaaccatgatggaataaggagctggggcttctttctgctggctgatgggtggacctgtgtatggtgacctctccggcctggccttttccattcgcatgaacaatgggagcacatagccctgttgacctgcccgatccagattcccaggccaggctcccgaccccatccacctatccaccaccccacccacctttgcagggaatacctcgttagagaatggcctgagacagtgcgttgcaactttttaattccatatcaaaagttgatttcttcttcattccatttatggaacttccctccccctagtccggttcttcttgtctttgtccctgttggtttgaagtgttagactatagcccctggtgtgtaaataatgtacatagagtgagaagaaagaaacttgatattgaggtgtttgaaatatggaactgtaataacttctaggtattcgaaacctgtgatttctgtgccattttctgtaaagatacaagtaagaataaaattgacttaaaaata

SEQ ID NO: 199172 - DNA, 4773 bp, Homo sapiens
  Payload ID: 19293
  Gene Name: vitamin D (1,25- dihydroxyvitamin D3) receptor
  Uniprot ID: P11473
  ENST ID: ENST00000229022
  CDS Start-End: 283-1566
ctgcttgtcaaaaggcggcagcggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaacc

SEQ ID NO: 199173 - DNA, 4762 bp, Homo sapiens
  Payload ID: 19293
  Gene Name: vitamin D (1,25- dihydroxyvitamin D3) receptor
  Uniprot ID: P11473
  ENST ID: ENST00000395324
  CDS Start-End: 270-1553
ggggacaggggtgaggccagagacggacggacgcaggggcccggcccaaggcgagggagaacagcggcactgaggcagaaaggaagagggcggtgtgttcacccgcagcccaatccatcactcagcaactcctagacgctggtagaaagttcctccgaggagcctgccatccagtcgtgcgtgcagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 199174 - DNA, 3925 bp, Homo sapiens
  Payload ID: 19293
  Gene Name: vitamin D (1,25- dihydroxyvitamin D3) receptor
  Uniprot ID: P11473
  ENST ID: ENST00000550325
  CDS Start-End: 374-1807
gtgtgcgccgggagcgcggaacagcttgtccacccgccggccggaccaggtgcgaacccgggagcagcgggaaagggggtctcaggatagggactcggggtcggggcgtctgggataccggggcctgagcgcccggctgcgagcattagagtctaagtctcagcggtaaacttggctactgaggtccgggctgtcgtgccatgaggctgggacactaaggggcactgaggtttgagaaagctgaagttcgtgccaggctggcgaggggagcagcgacatcctcggcgcttaggagaaatgctccgctaacacagtgcttagcacttgggcaacaagaagtatttgtttccttcttctgtcggggcgccttggcatggagtggaggaataagaaaaggagcgattggctgtcgatggtgctcagaactgctggagtggaggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaa

SEQ ID NO: 199175 - DNA, 937 bp, Homo sapiens
  Payload ID: 19293
  Gene Name: vitamin D (1,25- dihydroxyvitamin D3) receptor
  ENST ID: ENST00000546653
  CDS Start-End: 187-937
cggcagcggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggat

SEQ ID NO: 199176 - DNA, 1782 bp, Homo sapiens
  Payload ID: 19293
  Gene Name: vitamin D (1,25- dihydroxyvitamin D3) receptor
  ENST ID: ENST00000547065
  CDS Start-End: 71-220
aaaaggcggcagcggagccgtgtgcgccgggagcgcggaacagcttgtccacccgccggccggaccagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggtgagccctcctcccaggctctccccagtggaaagggagggagaagaagcaaggtgtttccatgaagggagcccttgcatttttcacatctccttccttacaatgtccatggaacatgcggcgctcacagccacaggagcaggagggtcttggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggca

SEQ ID NO: 199177 - DNA, 562 bp, Homo sapiens
  Payload ID: 19293
  Gene Name: vitamin D (1,25- dihydroxyvitamin D3) receptor
  ENST ID: ENST00000550314
  CDS Start-End: 245-562
gatgacatggcatgcctgctcccaacaagccacttctgtttgcagtcactgatctggggactaaagtccctggaaagagcctctcgtgcccacttccttagagactggggaggcggtcagcgctccgccttagataaaaggtttccccttcttcatttcagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatg

SEQ ID NO: 199178 - DNA, 4644 bp, Homo sapiens
  Payload ID: 19293
  Gene Name: vitamin D (1,25- dihydroxyvitamin D3) receptor
  Uniprot ID: P11473
  ENST ID: ENST00000549336
  CDS Start-End: 152-1435
aaaaggcggcagcggagccgtgtgcgccgggagcgcggaacagcttgtccacccgccggccggaccagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 199179 - DNA, 596 bp, Homo sapiens
  Payload ID: 19293
  Gene Name: vitamin D (1,25- dihydroxyvitamin D3) receptor
  ENST ID: ENST00000548664
  CDS Start-End: 292-596
gggctgtctctgcttgtcaaaaggcggcagcggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagag

SEQ ID NO: 199180 - DNA, 876 bp, Homo sapiens
  Payload ID: 19294
  Gene Name: vitamin K epoxide reductase complex, subunit 1
  ENST ID: ENST00000300851
  CDS Start-End: 32-481
ccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccagggtccaaggcactgggttgacagtcctaacctggttccaccccaccccacccctctgccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcagccaagtctgaa

SEQ ID NO: 199181 - DNA, 1077 bp, Homo sapiens
  Payload ID: 19294
  Gene Name: vitamin K epoxide reductase complex, subunit 1
  Uniprot ID: Q9BQB6
  ENST ID: ENST00000319788
  CDS Start-End: 212-682
cttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttagatggtgtctcgccatgttgcccaggctggtctcaagcaatctgtctgcctcagcctcccaaagtgctggggggattacaggcgttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcagccaagtctgaa

SEQ ID NO: 199182 - DNA, 901 bp, Homo sapiens
  Payload ID: 19294
  Gene Name: vitamin K epoxide reductase complex, subunit 1
  Uniprot ID: Q9BQB6
  ENST ID: ENST00000354895
  CDS Start-End: 228-506
gcgattccgcacgtcccttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcagccaagtctgaa

SEQ ID NO: 199183 - DNA, 664 bp, Homo sapiens
  Payload ID: 19294
  Gene Name: vitamin K epoxide reductase complex, subunit 1
  ENST ID: ENST00000394971
  CDS Start-End: 49-531
cgggagtgggaggcgtggggcctcggagcagggcggccaggatgccagatgattattctggagtctgggatcggtgtgcccggggaacggacacggggctggactgctcgcggggtcgttgcacaggggctgagctacccagcgatactggtgttcgaaataagagtgcgaggcaagggaccagacagtgctggggactgggattattccggggactcgcacgtgaattggatgccaaggaataacggtgaccaggaaaggcggggaggcaggatggcggtagagattgacgatggtctcaaggacggcgcgcaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatc

SEQ ID NO: 199184 - DNA, 1012 bp, Homo sapiens
  Payload ID: 19294
  Gene Name: vitamin K epoxide reductase complex, subunit 1
  Uniprot ID: Q9BQB6
  ENST ID: ENST00000394975
  CDS Start-End: 229-720
cgcgattccgcacgtcccttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcagccaagtctgaa

SEQ ID NO: 199185 - DNA, 870 bp, Homo sapiens
  Payload ID: 19294
  Gene Name: vitamin K epoxide reductase complex, subunit 1
  ENST ID: ENST00000498155
  CDS Start-End: 323-808
gcaaggaagaagtgaggaagtagagactgggagtgtagaatctttccaaaaacttgaatgtggaggggtagatgggataatgccgggagaggaggctggtgaaggacctcttagtgaagggagatttgttgctgtttctgagatgggaaagagaaacaagttgcagtgtagatggggaggatggagaggttgaaggtgtaggagagatgggtcaccatcagatgggacgtctgtgaaggagagacctcatctggcccacagcttggaaaggagagactgactgttgagttgatgcaagctcaggtgttgccaggcgggcgccatgatagtagagaggttaggatactgtcaagggtgtgtgtggccaaaggagtggttctgtgaatgtatgggagaaagggagaccgaccaccaggaagcactggtgaggcaggacccgggaggatgggaggctgcagcccgaatggtgcctgaaatagtttcaggggaaatgcttggttcccgaatcggatcgccgtattcgctggatcccctgatccgctggtctctaggtcccggatgctgcaattcttacaacaggacttggcatagggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttcc

SEQ ID NO: 199186 - DNA, 746 bp, Homo sapiens
  Payload ID: 19294
  Gene Name: vitamin K epoxide reductase complex, subunit 1
  ENST ID: ENST00000420057
  CDS Start-End: 1-278
gtcaagggtgtgtgtggccaaaggagtggttctgtgaatgtatgggagaaagggagaccgaccaccaggaagcactggtgaggcaggacccgggaggatgggaggctgcagcccgaatggtgcctgaaatagtttcaggggaaatgcttggttcccgaatcggatcgccgtattcgctggatcccctgatccgctggtctctaggtcccggatgctgcaattcttacaacaggacttggcatagggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcagccaagtctgaa

SEQ ID NO: 199187 - DNA, 461 bp, Homo sapiens
  Payload ID: 19294
  Gene Name: vitamin K epoxide reductase complex, subunit 1
  ENST ID: ENST00000472468
  CDS Start-End: 333-461
gtgacatggaatcctgacgtggccaaaggtgcccggtgccaggagatcatcgacccttggactaggatgggaggtcggggaacagaggatagcccaggtggcttcttggaaatcacctttctcgggcagggtccaaggcactgggttgacagtcctaacctggttccaccccaccccacccctctgccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctc

SEQ ID NO: 199188 - DNA, 5899 bp, Homo sapiens
  Payload ID: 19295
  Gene Name: vitamin K epoxide reductase complex, subunit 1-like 1
  Uniprot ID: Q8N0U8
  ENST ID: ENST00000360768
  CDS Start-End: 106-636
ggcggcggaggcggcggtggcggcggtggcggctgggtcgggccccgacgggcggcggcggctgaggtggaggcggagggaggcggcggcggcggcggcgggaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagatggggtcgaggatttggtcttttgggttccatttttggaaaggatggtgtattaaaccagccaaacagtgtctttggacttatattttatatactacagttattacttggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaaacatttgtttttagcagtaattccatgcctcatcttttttaagtgatttgttccaaatgaagccatttattgacttgatgttcacaaatatcatttgaagaaataacaggaattggggttagatgataaattctagggaatctaggtgatttggaggatttcatttgttttgcattacagctagttgctctcactaaaggtaaatttccggtgaaataactcaggtttaactagctgtgtgcccagaatcactgttccttcatacatgtgtcctctccttaaattcattactttcaaatgatgttcaaagcattgactattttcattcaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcatgccactgcactccagcctggccaacagagcgagactgtcccccccccaaaaaaaaaagagagagactgcattcaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttacctgtggaagttgtgctcccattattcttaaactgcagggttgcattccaaaagaactgaaacgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccccactgggtgcaatggctcatgcctgtaatcccagcactttgggaggtagaggcgggtggatcacttgaggtcaggagttcaagaccagcctggccaacatggtgaaacctgcctctactgaaaaatacagaaaaattagccaggattgtggtgtgcgcctgtaatcccagctattcaggaagctgaggcaggagaattgcttgaaccagggaggcggaggttgcagtgagacgagatcacgccactgcactgcagcctaggcgacagaggaagactccagctcaagaaaaaaaacaatggactgcccctaatttgtaaaccatttaaatgtgtctattacatttaacttttcttaatgtttgtcaactaaaagttttattcattatactttgacatactggaacacaaaacttgattcctttgaaaaactaaagagaagttgataaaaaaaatacagaagctctagattcctaattggaactgactacactcatttttaaaaaatggacgatgcctaataaaaccacatgaaattaacttta

SEQ ID NO: 199189 - DNA, 1541 bp, Homo sapiens
  Payload ID: 19295
  Gene Name: vitamin K epoxide reductase complex, subunit 1-like 1
  Uniprot ID: Q8N0U8
  ENST ID: ENST00000434382
  CDS Start-End: 4-537
aagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccaggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttca

SEQ ID NO: 199190 - DNA, 766 bp, Homo sapiens
  Payload ID: 19296
  Gene Name: vitelline membrane outer layer 1 homolog (chicken)
  Uniprot ID: Q7Z5L0
  ENST ID: ENST00000328739
  CDS Start-End: 81-689
gcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacagacagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtggtagagtcccagtctggaagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttga

SEQ ID NO: 199191 - DNA, 651 bp, Homo sapiens
  Payload ID: 19296
  Gene Name: vitelline membrane outer layer 1 homolog (chicken)
  Uniprot ID: Q7Z5L0
  ENST ID: ENST00000354194
  CDS Start-End: 82-294
ggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacagacagatggccggaacggctacacggcggtcatcgaagtgaccagcgggggtccctggggcgactgggcctggcctgagatgtgtcccgatggattcttcgccagcgggttctcgctcaagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttga

SEQ ID NO: 199192 - DNA, 712 bp, Homo sapiens
  Payload ID: 19296
  Gene Name: vitelline membrane outer layer 1 homolog (chicken)
  Uniprot ID: Q7Z5L0
  ENST ID: ENST00000416307
  CDS Start-End: 47-355
actgatataaatctgcttaggaggcctgattcacagacgctacaggatggagcggggcgcaggagccaagctgctgccgctgctgctgcttctgcgggcgactggtttcacatgtgcacagacagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtgctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttga

SEQ ID NO: 199193 - DNA, 741 bp, Homo sapiens
  Payload ID: 19296
  Gene Name: vitelline membrane outer layer 1 homolog (chicken)
  Uniprot ID: Q7Z5L0
  ENST ID: ENST00000441199
  CDS Start-End: 20-364
gattcacagacgctacaggatggagcggggcgcaggagccaagctgctgccgctgctgctgcttctgcgggcgactggtttcacatgtgcacagacagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtggtagagtcccagtctggaaggtggggcgcaggggtcgaggatcccttggggtgatgctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttga

SEQ ID NO: 199194 - DNA, 2525 bp, Homo sapiens
  Payload ID: 19297
  Gene Name: vitrin
  Uniprot ID: Q6UXI7
  ENST ID: ENST00000379241
  CDS Start-End: 127-2097
tagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgaca

SEQ ID NO: 199195 - DNA, 2810 bp, Homo sapiens
  Payload ID: 19297
  Gene Name: vitrin
  Uniprot ID: Q6UXI7
  ENST ID: ENST00000379242
  CDS Start-End: 303-2384
aattcagcactaaaaccagtgtgagaagcagtatgtgtgagcatgtgtgtgtgtgtatgtgtgtgggggggggtgtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatga

SEQ ID NO: 199196 - DNA, 2770 bp, Homo sapiens
  Payload ID: 19297
  Gene Name: vitrin
  Uniprot ID: Q6UXI7
  ENST ID: ENST00000389975
  CDS Start-End: 303-2339
aattcagcactaaaaccagtgtgagaagcagtatgtgtgagcatgtgtgtgtgtgtatgtgtgtgggggggggtgtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgacatgc

SEQ ID NO: 199197 - DNA, 2438 bp, Homo sapiens
  Payload ID: 19297
  Gene Name: vitrin
  ENST ID: ENST00000404084
  CDS Start-End: 167-2059
agaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgctgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttt

SEQ ID NO: 199198 - DNA, 2161 bp, Homo sapiens
  Payload ID: 19297
  Gene Name: vitrin
  Uniprot ID: Q6UXI7
  ENST ID: ENST00000401530
  CDS Start-End: 116-2089
ggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctggactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatg

SEQ ID NO: 199199 - DNA, 1344 bp, Homo sapiens
  Payload ID: 19297
  Gene Name: vitrin
  Uniprot ID: Q6UXI7
  ENST ID: ENST00000457137
  CDS Start-End: 229-840
gtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggcaagtgctcacgtgtgattgaatctaaaccttctgagtccatgaacacgcgacgtgttttgggagatagcggagaaattaacatcttaaccggtcaagctccactggctctggcaatattttaacagatgccaggaacatgggcacagaaatcaatgagatcagatggctggggctgaagaatgaaagctttattttttgtttttgcaattccgagattgtgtctctatatttgtgtcattttcattcagattgactgttgccttgagttttaatgtattgttgctttagaaaatgacatgacattctgtccggaaatgtttcctggcagctaaaaggaaaaagctgtatctacttagatatgaaatgaagagaagcaaagagaacgaggtggtttatgtgataacagcaagctgctcatccaaataacccaggccaaaaatacactgtctacaaggttgtgccaactcagctttcatgtgaaccacaaaagggagtatcggtagacctcaggccaagaaaatacctttttccaggtttctgtgttaaatcaagaactgtactatgcattattgtatctccagaggtgttttgatttcccacacaaagagaaactgtgagtcgcttta
